US010190131B2

(12) United States Patent
Cirpus et al.

(10) Patent No.: US 10,190,131 B2
(45) Date of Patent: Jan. 29, 2019

(54) METHOD FOR PRODUCING POLYUNSATURATED FATTY ACIDS

(75) Inventors: Petra Cirpus, Waldsee (DE); Jörg Bauer, Limburgerhof (DE); Xiao Qiu, Saskatoon (CA); Guohai Wu, Saskatoon (CA); Bifang Cheng, Saskatoon (CA); Martin Truksa, Edmonton (CA); Tom Wetjen, Mannheim (DE)

(73) Assignee: BASF Plant Science GmbH, Ludwigshafen (DE)

( * ) Notice: Subject to any disclaimer, the term of this patent is extended or adjusted under 35 U.S.C. 154(b) by 1009 days.

(21) Appl. No.: 12/280,090

(22) PCT Filed: Feb. 21, 2007

(86) PCT No.: PCT/EP2007/051675
§ 371 (c)(1),
(2), (4) Date: Aug. 20, 2008

(87) PCT Pub. No.: WO2007/096387
PCT Pub. Date: Aug. 30, 2007

(65) Prior Publication Data
US 2010/0227924 A1 Sep. 9, 2010

(30) Foreign Application Priority Data

Feb. 21, 2006 (DE) .................... 10 2006 008 030
Sep. 7, 2006 (EP) .................... 06120309

(51) Int. Cl.
*A61K 31/20* (2006.01)
*C12N 15/82* (2006.01)
*C12N 9/02* (2006.01)
*C12N 9/10* (2006.01)
*C12N 15/52* (2006.01)
*C12P 7/64* (2006.01)

(52) U.S. Cl.
CPC ....... *C12N 15/8247* (2013.01); *C12N 9/0071* (2013.01); *C12N 9/0083* (2013.01); *C12N 9/1029* (2013.01); *C12N 15/52* (2013.01); *C12P 7/6427* (2013.01); *C12Y 114/19* (2013.01)

(58) Field of Classification Search
None
See application file for complete search history.

(56) References Cited

U.S. PATENT DOCUMENTS

| 5,614,393 | A  | 3/1997  | Thomas et al. |
| 6,043,411 | A  | 3/2000  | Nishizawa et al. |
| 6,194,167 | B1 | 2/2001  | Browse et al. |
| 6,459,018 | B1 | 10/2002 | Knutzon |
| 6,884,921 | B2 | 4/2005  | Browse et al. |
| 7,211,656 | B2 | 5/2007  | Mukerji et |
| 7,238,851 | B2 | 7/2007  | Kang |
| 7,550,286 | B2* | 6/2009 | Damude ................. A23D 9/00 435/134 |
| 7,777,098 | B2 | 8/2010  | Cirpus et al. |
| 8,049,064 | B2* | 11/2011 | Cirpus ................. C12N 9/0083 435/320.1 |
| 8,088,974 | B2 | 1/2012  | Lerchl et al. |
| 8,455,035 | B2* | 6/2013 | Rein ....................... A23D 9/00 426/601 |
| 8,785,727 | B2* | 7/2014 | Bauer ................. C12N 9/0083 426/417 |
| 8,993,841 | B2* | 3/2015 | Napier .................. C12N 9/001 435/134 |
| 9,458,436 | B2* | 10/2016 | Cirpus .................... A23D 9/00 |
| 9,493,520 | B2* | 11/2016 | Bauer .................. C07K 14/435 |
| 2003/0163845 | A1 | 8/2003  | Mukerji et al. |
| 2003/0196217 | A1 | 10/2003 | Mukerji et al. |
| 2004/0049805 | A1 | 3/2004  | Lerchl et al. |
| 2004/0053379 | A1 | 3/2004  | Lerchl et al. |

(Continued)

FOREIGN PATENT DOCUMENTS

| AU | 2001239244 B2 | 8/2001 |
| AU | 2003232512 B2 | 11/2003 |

(Continued)

OTHER PUBLICATIONS

Robert (Marine Biotechnology, vol. 8, pp. 103-109, 2005).*
Qi, B., et al., "Production of Very Long Chain Polyunsaturated Omega-3 and Omega-6 Fatty Acids in Plants", Nature Biotechnol 2004, vol. 22, No. 6, pp. 739-745.
"Danio rerio Polyunsaturated Fatty Acid Elongase Protein", GenBank Database Accession No. AAN77156, Feb. 15, 2006.
Cronan, J.E. et al., "Biosynthesis of Membrane Lipids", in "*E. coli* and *Salmonella*", Section B2, Neidhardt, F.C. et al. eds., ASM Press, Washington, DC, (1996), pp. 612-636.

(Continued)

*Primary Examiner* — Hope Robinson
(74) *Attorney, Agent, or Firm* — Drinker Biddle & Reath LLP

(57) ABSTRACT

The invention relates to a method for producing eicosapentanoic acid, docosapentanoic acid and/or docohexanoic acid in transgenic plants. According to said method, the plant is provided with at least one nucleic acid sequence coding for a polypeptide with a Δ6 desaturase activity, at least one nucleic acid sequence coding for a polypeptide with a Δ6 elongase activity, at least one nucleic acid sequence coding for a polypeptide with a Δ5 desaturase activity, and at least one nucleic acid sequence coding for a polypeptide with a Δ5 elongase activity, the nucleic acid sequence coding for a polypeptide with a Δ5 elongase activity being modified in relation to the nucleic acid sequence in the organism from which the sequence originates, such that it is adapted to the codon use in at least one type of plant. For the production of docosahexanoic acid, at least one nucleic acid sequence coding for a polypeptide with a Δ4 desaturase activity is also introduced into the plant.

17 Claims, No Drawings
Specification includes a Sequence Listing.

(56) References Cited

U.S. PATENT DOCUMENTS

| | | | |
|---|---|---|---|
| 2004/0111763 | A1 | 6/2004 | Heinz et al. |
| 2004/0172682 | A1 | 9/2004 | Kinney et al. |
| 2008/0076164 | A1 | 3/2008 | Cirpus et al. |
| 2008/0155705 | A1* | 6/2008 | Zank et al. .................... 800/13 |
| 2009/0222951 | A1 | 9/2009 | Cirpus et al. |
| 2010/0021976 | A1 | 1/2010 | Lerchl et al. |
| 2013/0116421 | A1 | 5/2013 | Cirpus et al. |

FOREIGN PATENT DOCUMENTS

| | | |
|---|---|---|
| AU | 2003258496 A1 | 1/2004 |
| AU | 2004215705 B2 | 9/2004 |
| AU | 2004225838 B2 | 10/2004 |
| AU | 2004227075 B8 | 10/2004 |
| AU | 2005217080 B2 | 9/2005 |
| CA | 2 485 060 | 11/2003 |
| CA | 2559360 A1 | 9/2005 |
| DE | 101 02 337 A1 | 7/2002 |
| DE | 102 19 203 | 11/2003 |
| EP | 0 550 162 | 7/1993 |
| EP | 0 794 250 | 9/1997 |
| WO | WO-91/13972 | 9/1991 |
| WO | WO-93/06712 | 4/1993 |
| WO | WO-93/11245 | 6/1993 |
| WO | WO-94/11516 | 5/1994 |
| WO | WO-94/18337 | 8/1994 |
| WO | WO-95/18222 A1 | 7/1995 |
| WO | WO-96/21022 | 7/1996 |
| WO | WO-97/21340 | 6/1997 |
| WO | WO-97/30582 | 8/1997 |
| WO | WO-98/46763 | 10/1998 |
| WO | WO-98/46764 | 10/1998 |
| WO | WO-98/46765 | 10/1998 |
| WO | WO-98/46776 | 10/1998 |
| WO | WO-99/27111 | 6/1999 |
| WO | WO-99/64616 | 12/1999 |
| WO | WO-00/12720 | 3/2000 |
| WO | WO-00/21557 | 4/2000 |
| WO | WO-01/59128 | 8/2001 |
| WO | WO-01/85968 A2 | 11/2001 |
| WO | WO-02/08401 | 1/2002 |
| WO | WO-02/26946 A2 | 4/2002 |
| WO | WO-02/44320 | 6/2002 |
| WO | WO-02/057464 A2 | 7/2002 |
| WO | WO-02/057465 A2 | 7/2002 |
| WO | WO-02/061668 A2 | 10/2002 |
| WO | WO-02/077213 | 10/2002 |
| WO | WO-02/081668 A2 | 10/2002 |
| WO | WO-02/090493 A2 | 11/2002 |
| WO | WO-02/092540 A1 | 11/2002 |
| WO | WO-03/064596 A2 | 8/2003 |
| WO | WO-03/102138 A2 | 12/2003 |
| WO | WO-2004/005442 A1 | 1/2004 |
| WO | WO-2004/057001 A2 | 7/2004 |
| WO | WO-2004/071467 | 8/2004 |
| WO | WO-2005/012316 A2 | 2/2005 |
| WO | WO-00/34439 A1 | 9/2005 |
| WO | WO-2005/083053 A2 | 9/2005 |
| WO | WO-2005/083093 A2 | 9/2005 |
| WO | WO-2005/103253 A1 | 11/2005 |
| WO | WO-2006/008099 A2 | 1/2006 |
| WO | WO-2010/057246 A1 | 5/2010 |

OTHER PUBLICATIONS

Gerhardt, B., "Fatty Acid Degradation in Plants", Prog. Lipid Res. 31:4 (1992), pp. 417-446.
Wada, H. et al., "Enhancement of Chilling Tolerance of a Cyanobacterium by Genetic Manipulation of Fatty Acid Desaturation", Nature 347 (1990), pp. 200-203.
Yu, R. et al., "Production of Eicosapentaenoic Acid by a Recombinant Marine Cyanobacterium, *Synechococcus* sp.", Lipids, 35:10 (2000), pp. 1061-1064.

Magnuson, K. et al., "Regulation of Fatty Acid Biosynthesis in *Escherichia coli*", Microbiological Reviews, 57:3 (1993), pp. 522-542.
Akimoto, M. et al., "Carbon Dioxide Fixation and Polyunsaturated Fatty Acid Production by the Red Alga *Porphyridium cruentum*", Applied Biochemistry and Biotechnology 73 (1998), pp. 269-278.
Stymne, S., "Biosynthesis of 'Uncommon' Fatty Acids and Their Incorporation into Triacylglycerols", Biochemistry and Molecular Biology of Membrane and Storage Lipids of Plants, N. Murata et al., Editors, The American Society of Plant Physiologists (1993), pp. 150-158.
Frentzen, M., "Acyltransferases from Basic Science to Modified Seed Oils", Fett/Lipid, 100:4-5, S. (1998), pp. 161-166.
Shanklin, J. et al., "Desaturation and Related Modifications of Fatty Acids", Annu. Rev. Plant Physiol. Plant Mol. Biol. 49 (1998), pp. 611-641.
Drexler, H. et al., "Metabolic Engineering of Fatty Acids for Breeding of New Oilseed Crops: Strategies, Problems and First Results", J. Plant Physiol. 160 (2003), pp. 779-802.
Domergue, F. et al., "Cloning and Functional Characterization of *Phaeodactylum tricornutum* Front-End Desaturases Involved in Eicosapentaenoic Acid Biosynthesis", Eur. J. Biochem. 269 (2002), pp. 4105-4113.
Totani, N. et al., "The Filamentous Fungus *Mortierella alpina*, High in Arachiodonic Acid", Lipids, 22:2 (1987), pp. 1060-1062.
Cleland, L.G. et al., "Fish Oil and Rheumatoid Arthritis: Antiinflammatory and Collateral Health Benefits", The Journal of Rheumatology, 27:10 (2000), pp. 2305-2307.
Vazhappilly, R. et al., "Heterotrophic Production Potential of Omega-3 Polyunsaturated Fatty Acids by Microalgae and Algae-like Microorganisms", Botanica Marina 41 (1998), pp. 553-558.
Tvrdik, P. et al., "Role of a New Mammalian Gene Family in the Biosynthesis of Very Long Chain Fatty Acids and Sphingolipids", The Journal of Cell Biology, 149:3 (2000) pp. 707-717.
Guehnemann-Schaefer, K. et al., "Fatty Acid β-oxidation in Glyoxysomes. Characterization of a New Tetrafunctional Protein (MFPIII)", Biochimica et Biophysica Acta 1256 (1995), pp. 181-186.
Meyer, A. et al., "Novel Fatty Acid Elongases and Their Use for the Reconstitution of Docosahexaenoic Acid Biosynthesis", Journal of Lipid Research 45 (2004), pp. 1899-1909.
Sakuradani, E. et al., "Δ6-Fatty Acid Desaturase from a Arachidonic Acid-Producing *Mortierella* Fungus Gene Cloning and Its Heterologous Expression in a Fungus, *Aspergillus*", Gene 238 (1999), pp. 445-453.
Stukey, J. E. et al., "The *OLE1* Gene of *Saccharomyces cerevisiae* Encodes the Δ9 Fatty Acid Desaturase and Can Be Functionally Replaced by the Rat Stearoyl-CoA Desaturase Gene", The Journal of Biological Chemistry 265:33 (1990), pp. 20144-20149.
Huang, Y-S. et al., "Cloning of Δ12- and Δ6-Desaturases from *Mortierella alphina* and Recombinant Production of γ-Linolenic Acid in *Saccharomyces cerevisiae*", Lipids 34:7 (1999), pp. 649-659.
Takeyama, H. et al., "Expression of the Eicosapentaenoic Acid Gene Cluster from *Shewanella* sp. in a Transgenic Marine Cyanobacterium, *Synechococcus* sp.", Microbiology 143 (1997), pp. 2725-2731.
Wang, X. M. et al., "Biosynthesis and Regulation of Linolenic Acid in Higher Plants", Physiol. Biochem. 26:6 (1998), pp. 777-792.
Zank, T. K. et al., "Cloning anf Functional Characterisation of an Enzyme Involved in the Elongation of Δ6-polyunsaturated Fatty Acids from the Moss *Physcomitrella patens*", The Plant Journal 31:3 (2002), pp. 255-268.
Millae, A. A. et al., "*CUT1*, an Arabidopsis Gene Required for Cuticular Wax Biosynthesis and Pollen Fertility, Encodes a Very-Long-Chain Fatty Acid Condensing Enzyme", The Plant Cell 11 (1999), pp. 825-838.
Calder, P. C., "Dietary Modification of Infammation with Lipids", Proceedings of the Nutrition Society 61 (2002), pp. 345-358.
Kunau, W.-H., et al., "β-oxidation of Fatty Acids in Mitochondra, Peroxisomes, and Bacteria: A Century of Continued Progress", Prog. Lipid Res. 34:4 (1995) pp. 267-342.

(56) References Cited

OTHER PUBLICATIONS

Beaudoin, F. et al., "Heterologous Reconstitution in Yeast of the Polyunsaturated Fatty Acid Biosynthetic Pathway", Proceedings of the National Academy of Sciences of the United States of America 97:12 (2000), pp. 6421-6426.
Ohlrogge, J. et al., "Lipid Biosynthesis", The Plant Cell 7 (1995), pp. 957-970.
Millar, A.A. et al., "Very-long-chain Fatty Acid Biosynthesis is Controlled through the Expression and Specificity of the Condensing Enzyme", The Plant Journal 12:1 (1997), pp. 121-131.
Shimokawa, H., "Beneficial Effects of Eicosapentaenoic Acid on Endothelial Vasodilator Functions in Animals and Humans", World Rev. Nutr. Diet 88 (2001), pp. 100-108.
Chalova, L. I., et al. "The Composition of Lipids of Phytophthora infestans and Their Ability to Induce Potato Phytoalexin Accumulation". Biokhimiya, 1987, vol. 52, No. 9, pp. 1445-1453; also see Database BIOSIS, Abstract No. PREV198885045135.
Abbadi, A. et al., "Biosynthesis of Very-Long-Chain Polyunsaturated Fatty Acids in Transgenic Oilseeds: Constraints on Their Accumulation", The Plant Cell 16 (2004), pp. 2734-2748.
"My-26-A-10 PinfestansMY Phytophthora infestans cDNA, mRNA sequence." Database EMBL, Accession No. BE777235, Sep. 21, 2000.
Kamoun, S. et al., "Initial Assessment of Gene Diversity for the Oomycete Pathogen Phytophthora infestans Based on Expressed Sequences", Fungal Genetics and Biology 28 (1999), pp. 94-106.
Khozin, I. et al., "Elucidation of the Biosynthesis of Eicosapentaenoic Acid in the Microalga Porphyridium cruentum", Plant Physiol. 114 (1997), pp. 223-230.
Pereira, S.L. et al., "A Novel ω3-Fatty Acid Desaturase Involved in the Biosynthesis of Eicosapentaenoic Acid", Biochem. J. 378 (2004), pp. 665-671.
Pereira, S.L. et al., "Recent Advances in the Study of Fatty Acid Desaturases from Animals and Lower Eukaryotes", Prostaglandins, Leukotrienes and Essential Fatty Acids 68 (2003), pp. 97-106.
Spychalla, J.P. et al., "Identification of an Animal ω-3 Fatty Acid Desaturase by Heterologous Expression in Arabidopsis", Proc. Natl. Acad. Sci. USA 94 (1997), pp. 1142-1147.
Kajikawa, M., et al., "Isolation and Functional Characterization of Fatty Acid Δ5-Elongase Gene from the Liverwort Marchantia polymorpha L.", FEBS Letters, 2006, vol. 580, pp. 149-154.
Robert, S. S., et al., "Isolation and Characterisation of a Δ5-Fatty Acid Elongase from the Marine Microalga Pavlova salina", Mar. Biotechnol., 2009, vol. 11, pp. 410-418.
Pereira, S. L., et al., "Identification of Two Novel Microalgal Enzymes Involved in the Conversion of the ω3-Fatty Acid, Eicosapentaenoic Acid, into Docosahexaenoic Acid", Biochem. J., 2004, vol. 384, pp. 357-366.
Leonard, A. E., et al., "Elongation of Long-Chain Fatty Acids", Progress in Lipid Research, 2004, vol. 43, pp. 36-54.
Sperling, P., et al., "The Evolution of Desaturases", Prostaglandins, Leukotrienes and Essential Fatty Acids, 2003, vol. 68, pp. 73-95.
Domergue, F., et al., "New Insight into Phaeodactylum tricornutum Fatty Acid Metabolism. Cloning and Functional Characterization of Plastidial and Microsomal Δ12-Fatty Acid Desaturases", Plant Physiology, 2003, vol. 131, pp. 1648-1660.
Wu, G., et al., "Stepwise Engineering to Produce High Yields of Very Long-Chain Polyunsaturated Fatty Acids in Plants", Nature Biotechnology, 2005, vol. 23, No. 8, pp. 1013-1017.
Nakamura, M. T., et al., "Structure, Function, and Dietary Regulation of Δ6, Δ5, and Δ9 Desaturases", Annu. Rev. Nutr., 2004, vol. 24, pp. 345-376.
"P. patens Delta6 Elongase SEQ ID 29", GeneSeq Database Accession No. ABG73608, Mar. 25, 2003.
"Subname: Full = Polyunsaturated Fatty Acid Elongase elvol5a", UniProt Database Accession No. Q8AWE7, Oct. 25, 2005.
"Polyunsaturated Fatty Acid Elongase (ELOVL Family Member 5, Elongation of Long Chain Fatty Acids) (Yeast)", UniProt Database Accession No. Q8AX86, Mar. 1, 2003.
"633167 NCCCWA 1RT Oncorhynchus Mykiss cDNA Clone 1RT126D03_B_B02 5', mRNA Sequence", EMBL Database Accession No. CA360014, Nov. 7, 2002.
"LOC398440 Protein", UniProt Database Accession No. Q7ZXJ4, Jun. 1, 2003.
Huang, Y.-S., et al., "Enzymes for Transgenic Biosynthesis of Long-Chain Polyunsaturated Fatty Acids", Biochimie, 2004, vol. 86, No. 11, pp. 793-798.
"Physcomitrella patens Desaturase Encoding cDNA SEQ ID No. 7", GeneSeq Database Accession No. ABV74260, Mar. 28, 2003.
"Phaeodactylum tricornutum Desaturase Encoding cDNA SEQ ID No. 11", GeneSeq Database Accession No. ABV74262, Mar. 28, 2003.
Sprecher, H. "Metabolism of Highly Unsaturated n-3 and n-6 Fatty Acids", Biochimica et Biophysica Acta, 2000, vol. 1486, pp. 219-231.
"Nouveau Dictionnaire des Huiles Végétales: Compositions en Acides Gras", Ucciani E., Ed. Technique & Documentation—Lavoisier, 1995, ISBN: 2-7430-0009-0, pp. 577, 578 and 582.
"Phaeodactylum tricornutum Elongase Encoding cDNA SEQ ID No. 9",GeneSeq Database Accession No. ABV74261, Mar. 28, 2003.
Bork, P., et al., "Go Hunting in Sequence Databases but Watch Out for the Traps", Trends in Genet. 12:10 (1996), pp. 425-427.
Broun, P., et al., "Catalytic Plasticity of Fatty Acid Modification Enzymes Underlying Chemical Diversity of Plant Lipids", Science 282:5392 (1998), pp. 1315-1317.
van de Loo, F. J., et al., "An Oleate 12-Hydroxylase from Ricinus communis L. is a Fatty Acyl Desaturase Homolog", Proc. Natl. Acad. Sci. U S A 92:15 (1995), pp. 6743-6747.
Doerks, T., et al., "Protein Annotation: Detective Work for Function Prediction", Trends in Genet. 14:6 (1998), pp. 248-250.
Brenner, S. E., "Errors in Genome Annotation", Trends in Genet. 15:4 (1999), pp. 132-133.
Yu, Z., et al., "Study on Nutritional Function of Polyunsaturated Fatty Acid", China Feed, 2003, Issue 24, pp. 21-23.
Sakuradani, E. et al., "Δ6-Fatty Acid Desaturase from an Arachidonic Acid-Producing Mortierella Fungus Gene Cloning and its Heterologous Expression in a Fungus. Aspergillus". Gene 238 (1999), pp. 445-453.
Kinny, A.J., "Genetic Engeering of Oilseeds for Desired Traits", in "Genetic Engineering, Principles and Methods", vol. 19, Editor: J.Setlow, (1997), pp. 149-166.
Voelker, T., "Plant Acyl-ACP Thioesterases: Chain-Length Determining Enzymes in Plant Fatty Acid Biosynthesis", in "Genetic Engineering, Principles and Methods", vol. 18, Editor: J. Setlow. (1996), pp. 111-113.
Stukey, J.E. et al., "The OLE1 Gene of Saccharomyces cerevisiae Encodes the Δ9 Fatty Acid Desaturase and Can be Functionally Replaced by the Rad Stearoyl-CoA Desaturase Gene", The Jounal of Biological Chemistry 265:33 (1990), pp. 20144-20149.
Zank, T.K. et al., "Cloning and Functional Expression of the First Plant Fatty Acid Elongase Specific for Δ6-Polyunsaturated Fatty Acids", Biochemical Society Transactions 28:6 (2000), pp. 654-658.
Poulos, A., "Very Long Chain Fatty Acids in Higher Animals—A Review", Lipids 30:1 (1995): pp. 1-14.
Huang, Y-S. et al., "Cloning of Δ12- and Δ6-Desaturases from Mortierella alpina and Recombinant Production of γ-Linolenic Acid in Saccharomyces cerevisiae". Lipids 34:7 (1999), pp. 649-659.
Tocher, D.R. et al., "Recent Advances in the Biochemistry and Molecular Biology of Fatty Acyl Desaturases", Prog. Lipid Res. 37:2/3 (1998), pp. 73-117.
Horrocks, L.A. et al., "Health Benefits of Docosahexaenoic Acid (DHA)", Pharmacological Research 40:3 (1999), pp. 211-225.
McKeon, T. et al., "Stearoyl-Acyl Carrier Protein Desaturase from Safflower Seeds", in Methods in Enzymology, vol. 71, Part C: Lipids, Editor: J. Lowenstein (1981), New York, pp. 275-281.
Takeyama, H. et al., "Expression of the Eicosapentaenoic Acid Synthesis Gene Cluster from Shewanella sp. in a Transgenic Marine Cyanobacterium, Synechococcus sp.", Microbiology 143 (1997), pp. 2725-2731.

(56) References Cited

OTHER PUBLICATIONS

Murphy, D.J. et al., "Biosynthesis, Targeting and Processing of Oleosin-like Proteins, Which are Major Pollen Coat Components in *Brassica napus*", The Plant Journal 13:1 (1998), pp. 1-16.
Wang, X.-M. et al., "Biosynthesis and Regulation of Linolenic Acid in Higher Plants", Physiol. Biochem. 26:6 (1988), pp. 777-792.
Zank, T.K. et al., "Cloning and Functional Characterisation of an Enzyme Involved in the Elongation of Δ6-polyunsaturated Fatty Acids fro the Moss *Physcomitrella patens*", The Plant Journal 31:3 (2002), pp. 255-268.
Millar, A.A. et al., "*CUT1*, an Arabidopsis Gene Required for Cuticular Wax Biosynthesis and Pollen Fertility, Encodes a Very-Long-Chain Fatty Acid Condensing Enzyme", The Plant Cell 11 (1999), pp. 825-838.
Calder, P.C., "Dietary Modification of Inflammation with Lipids", Proceedings of the Nutrition Society 61 (2002), pp. 345-358.
U.S. Appl. No. 60/613,861, Singh et al.
Robert, S. S., et al., "Metabolic Engineering of *Arabidopsis* to Produce Nutritionally Important DHA in Seed Oil", Functional Plant Biology, 2005, vol. 32, pp. 473-479.
Stirn, S., et al., "Genetically Modified Plants", Chapter 2 in "Genetically Engineered Food: Methods and Detection", Heller K. J., Ed., Wiley-VCH Verlag GmbH & Co., KGaA, Weinheim, Germany, Publiched Online Jan. 7, 2005, pp. 26-61.
Wolff, R. L., et al., "Arachidonic, Eicosapentaenoic, and Biosynthetically Related Fatty Acids in the Seed Lipids from a Primitive Gymnosperm, *Agathis robusta*", Lipids, 1999, vol. 34, No. 10, pp. 1083-1097.
Hong, H. et al., "High-Level Production of γ-Linolenic Acid in *Brassica juncea* Using a Δ6 Desaturase from *Pythium irregulare*", Plant Physiology, 2002, vol. 129, pp. 354-362.
Abbadi, A., et al., "Transgenic Oilseeds as Sustainable Sources of Nutritionally Relevant C20 and C22 Polyunsaturated Fatty Acids?", Eur. J. Lipid Sci. Technol., 2001, vol. 103, pp. 106-113.
Sayanova, O. V., et al., "Eicosapentaenoic Acid: Biosynthetic Routes and the potential for synthesis in Transgenic Plants", Phytochemistry, 2004, vol. 65, pp. 147-158.
Heinz, E., "Docosahexaenoic Acid (DHA) in transgenic Oilseeds: Which Approach Will Be Successful First?", European Journal of Lipid Science and Technology, 2002, vol. 104, pp. 1-2.
Lui, J. W., et al., "Evaluation of the Seed Oils from a Canola Plant Genetically Transformed to Produce High Levels of γ-Linolenic Acid", Chapter 7 in "γ-Linolenic acid: Recent Advances in Biotechnology and Clinical Applications", Eds. Huang and Ziboh, AOCS Press, Champaign, Illinois, 2001, pp. 61-71.
Derelle, E., et al., "DNA Libraries for Sequencing the Genome of *Ostreococcus Tauri* (Chlorophyta Prasinophyceae): The Smallest Free-Living Eukaryotic Cell", J. Phycol, 2002, vol. 38, pp. 1150-1156.
Derelle, E., et al., "Genome Analysis of the Smallest Free-Living Eukaryote Ostreococcus Tauri Unviels Many Unique Features", PNAS, 2006, vol. 103, No. 31, pp. 11647-11652.
Ral, J. P., et al., "Starch Division and Partitioning. A Mechanism for Granule propagation and Maintenance in the Picophytoplanktonic Green Alga *Ostreococcus Tauri* ", Plant Physiology, 2004, vol. 136, pp. 3333-3340.
"*Ostreococcus Tauri* Delta-6-Desaturase (d6) Gene, Complete cds", Database EMBL Accession No. AY746357, July 8, 2005.
Sayanova, O. V., et al., "Identification of *Primula* Fatty Acid ?$^6$-Desaturases with *n*-3 Substrate Preferences", FEBS Letters, 2003, vol. 542, pp. 100-104.
Deaudoin, F., et al., "Production of $C_{20}$ Polyunsaturated Fatty Acids (PUFAs) by Pathway Engineering: Identification of PUFA Elongase Component from *Caenorhabditis elegans*", Biochemical Society Transactions, 2000, vol. 28, pp. 661-663.
Parker-Barnes, J. M., et al., "Identification and Characterization of an Enzyme Involved in the Elongation of n-6 and n-3 Polyunsaturated Fatty Acids", PNAS, vol. 97, 2000, vol. 97, No. 15, pp. 8284-8289.

Thurmond, T. Das J. M., et al., "Polyunsaturated Fatty Acid-Specific Elongation Enzymes", Biochemical Society Transactions, 2000, vol. 28, pp. 658-660.
Sato, S., et al., "Production of γ-Linolenic Acid and Stearidonic Acid in Seeds of Marker-Free Transgenic Soybean", Crop Science, 2004, vol. 44, pp. 646-652.
Inagaki, K, et al., "Identification and Expression of a Rat Fatty Acid Elongase Involved in the Biosynthesis of C18 Fatty Acids", Biosci, Biotechnol. Biochem., 2002, vol. 66, No. 3, pp. 613-621.
Wallis, J. G., et al., "The $\Delta^8$-Desaturase of *Euglena gracilis*: An Alternatice Pathway for Synthesis of 20-Carbon Polyunsaturated fatty Acids", Archives of Biochemistry and Biophysics, 1999, vol. 365, No. 2, pp. 307-316.
Qi, B., et al., "Identification of cDNA Encoding a Novel C18-$\Delta^9$ Polyunsaturated Fatty Acid-Specific Elongating Activity From the Docosahexaenoic Acid (DHA)-Producing Microalga, *Isochrysis galbana*", FEBS Letters, 2002, vol. 510, pp. 159-165.
Qi, B., et al., "Production of Very Long Chain Polyunsaturated Omega-3 and Omega-6 Fatty Acids in Plants", Nature Biotechnology, 2004, vol. 22, No. 6, pp. 739-745.
Knutzon, D. S., et al., "Identification of Δ5-Desaturase from *Mortierella alphina* by Heterologous Expression in Bakers' Yeast and Canola", The Journal of Biological Chemistry, 1998, vol. 273, No. 45, pp. 29360-29366.
Leonard, A. E., et al., "cDNA Cloning and Characterization of Human $\Delta^5$-Desaturase Involved in the Biosynthesis of Arachidonic Acid", Biochem. J., 2000, vol. 347, pp. 719-724.
Hong, H., et al., "Isolation and Characterization of a Δ5 FA Desaturase from *Pythium irregulare* by Heterologous Expression in *Saccharomyces cerevisiae* and Oilseed Crops", Lipids, 2002, vol. 37, No. 9, pp. 863-868.
Leonard, A. E., et al., "Cloning of a Human cDNA Encoding a Novel Enzyme Involved in the Elongation of Long-Chain Polyunsaturated Fatty Acids", Biochem. J., 2000, vol. 350, pp. 765-770.
Leonard, A. E., et al., "Identification and Expression of Mammalian Long-Chain PUFA Elongation Enzymes", Lipids, 2002, vol. 37, No. 8, pp. 733-740.
Agaba, M., et al., "Zebrafish cDNA Encoding Multifunctional Fatty Acid Elongase Involved in Production of Eicosapentaenoic (20:5n-3) and Docosahexaenoic (22:6n-3) Acids", Marine Biotechnology, 2004, vol. 6, pp. 251-261.
Armbrust, E. V., et al., "The Genome of the Diatom *Thalassiosira pseudonana*: Ecology, Evolution, and Metabolism", Science, 2004, vol. 306, pp. 79-86.
Clough, S. J., et al., "Floral Dip: A Simplified Method for agrobacterium-Mediated Transformation of *Arabidopsis thaliana*", The Plant Journal, 1998, vol. 16, No. 6, pp. 735-743.
Qiu, X., et al., "Identification of a Δ4 Fatty Acid Desaturase from *Thraustochytrium* sp. Involved in the Biosynthesis of Docosahexanoic Acid by Heterologous Expression in *Saccharomyces cerevisiae* and *Brassica juncea*", The Journal of Biological Chemistry, 2001, vol. 276, No. 34, pp. 31561-31566.
Millar, A. A., et al., "Accumulation of Very-Long-Chain Fatty Acids in Membrane Glycerolipids Is Associated with Dramatic Alternations in Plant Morphology", The Plant Cell, 1998, vol. 11, pp. 1889-1902.
Domergue, F., et al., "In Vivo Characterization of the First Acyl-CoA $\Delta^6$-Desaturase from a Member of the Plant Kingdom, the Microalga *Ostreococcus tauri*", Biochem. J., 2005, vol. 389, pp. 483-490.
Venegas-Calerón, M., et al., "An Alternative to Fish Oils: Metabolic Engineering of Oil-Seed Crops to Produce Omega-3 Long Chain Polyunsaturated Fatty Acids", Progress in Lipid Research, 2010, vol. 49, pp. 108-119.
Meyer, A., et al., "Biosynthesis of Docosahexaenoic Acid in *Euglena gracilis*: Biochemical and Molecular Evidence for the Involvement of a Δ4-Fatty Acyl Group Desaturase", Biochemistry, 2003, vol. 42, pp. 9779-9788.
Domergue, F., et al., "Acyl Carriers Used as Substrates by the Desaturases and Elongases Involved in Very Long-chain Polyunsaturated Fatty Acids Biosynthesis Reconstituted in Yeast", The Journal of Biological Chemistry, 2003, vol. 278, No. 37, pp. 35115-35126.

(56) References Cited

OTHER PUBLICATIONS

Gunstone, F. D., "Vegetable Oils", In: Bailey's Industrial Oil and Fat Products, Sixth Edition, Six Volume Set, pp. 213-267, Ed. Shahidi, John Wiley & Sons, Inc., 2005.

Ursin, V., et al., "Production of beneficial Dietary Omega-3 and Omega 6 Fatty Acids in Transgenic Canola", Abstract No. 49, 14th International Symposium Plant Lipids, 2000.

"Codex Standard for Named Vegetable Oils—CX-STAN 210-1999", excerpt from Codex Alimentarius, 2001, vol. 8, pp. 11-25.

"Danio rerio Polyunsaturated Fatty Acid Elongase mRNA. Complete cds". Database GenBank, Accession No. AF532782, Feb. 15, 2006.

"Phaeodactylum tricornutum Delta 12 Fatty Acid Desaturase mRNA. Complete cds; Nuclear Gene for Microsomal Protein". Database GenBank. Accession No. AY165023. Apr. 14, 2003.

Girke, T., et al., "Identification of a Novel Δ6-Acyl-Group Desaturase by Targeted Gene Disruption in Physcomitrella patens". The Plant Journal. 1998, vol. 15, No. 1, pp. 39-48.

Michaelson. L., et al., "Functional Identification of a Fatty Acid Δ5 Desaturase Gene from Caenorhabditis elegans". FEBS Letters, 1998, vol. 439, No. 3, pp. 215-218.

Michaelson, L. V., et al., "Isolation of a Δ5-Fatty Acid Desaturase Gene from Mortierella alpina", The Journal of Biological Chemistry. 1998. vol. 273, No. 30, pp. 19055-19059.

Moon, Y. A., et al., "Identification of a Mammalian Long Chain Fatty Acyl Elongase Regulated by Sterol Regulatory Element-Binding Proteins". The Journal of Biological Chemistry, 2001, vol. 276, No. 48, pp. 45358-45366.

Sayanova, et al., "Expression of a Borage Desaturase cDNA Containing an N-Terminal Cytochrome b5 Domain Results in the Accumulation of High Levels of Δ6-Desaturated Fatty Acids in Transgenic Tobacco". Proc. Natl. Acad. Sci USA. 1997, vol. 94, pp. 421-4216.

"Future Considerations", p. 221 of "Bailey's Industrial Oil and Fat Products". Sixth Edition, vol. 6, Shahidi, F., Ed., John Wiley & Sons. Inc., 2005.

Sperling, P., et al., "A Bifunctional Δ6-Fatty Acyl Acetylenase/Desaturase from the Moss Ceratodon purpureus". European Journal of Biochemistry, 2000, vol. 267, No. 12, pp. 3801-3811.

Tonon, T., et al., "Identification of a Very Long Chain Polyunsaturated Fatty Acid Δ4-Desaturase from the Microalga Pavlova Lutheri", FEBS Letters, vol. 553, No. 3, pp. 440-444.

Watts, J. L., et al., "Isolation and Characterization of aΔ5-Fatty Acid Desaturase from Caenorhabditis elegans". Archives of Biochemistry and Biophysics. 1999. vol. 362, No. 1, pp. 175-182.

Kang, Z. B., et al., "Adenoviral Gene Transfer of *Caenorhabditis elegans* n-3 Fatty Acid Desaturase Optimizes Fatty Acid Composition in Mammalian Cells". PNAS. 2001, vol. 98, No. 7, pp. 4050-4054.

Wagner, et al., "Generation of glycerophospholipid Molecular species in the yeast Saccharomyces cerevisiae. Fatty acid pattern of phospholipid classes and selective acyl turnover at sn-1 and sn-2 positions", Yeast, Vol. 10, 1994, pp. 1429-1437.

Diedrich, et al., "The naural occurrence of unusual fatty acids. Part 1. Odd numbered fatty acids", Molecular Nutrition & Food Research, Vol. 34, Issue 10, 1990, pp. 935-943.

\* cited by examiner

METHOD FOR PRODUCING POLYUNSATURATED FATTY ACIDS

RELATED APPLICATIONS

This application is a national stage application (under 35 U.S.C. 371) of PCT/EP2007/051675, filed Feb. 21, 2007, which claims benefit of German application 10 2006 008 030.0, filed Feb. 21, 2006 and European application 06120309.7, filed Sep. 7, 2006.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Revised_Sequence_Listing_13477_00013. The size of the text file is 730 KB, and the text file was created on May 19, 2010.

The present invention relates to a process for the production of eicosapentaenoic acid, docosapentaenoic acid and/or docosahexaenoic acid in transgenic plants, providing in the plant at least one nucleic acid sequence which codes for a polypeptide having a Δ6-desaturase activity; at least one nucleic acid sequence which codes for a polypeptide having a Δ6-elongase activity; at least one nucleic acid sequence which codes for a polypeptide having a Δ5-desaturase activity; and at least one nucleic acid sequence which codes for a polypeptide having a Δ5-elongase activity, where the nucleic acid sequence which codes for a polypeptide having a Δ5-elongase activity is modified by comparison with the nucleic acid sequence in the organism from which the sequence is derived in that it is adapted to the codon usage in one or more plant species.

In a preferred embodiment there is additionally provision of further nucleic acid sequences which code for a polypeptide having the activity of an ω3-desaturase (Fad3) and/or of a Δ4-desaturase in the plant.

In a further preferred embodiment there is provision of further nucleic acid sequences which code for acyl-CoA dehydrogenase(s), acyl-ACP (acyl carrier protein) desaturase(s), acyl-ACP thioesterase(s), fatty acid acyl transferase(s), acyl-CoA:lysophospholipid acyl transferase(s), fatty acid synthase(s), fatty acid hydroxylase(s), acetyl-coenzyme A carboxylase(s), acyl-coenzyme A oxidase(s), fatty acid desaturase(s), fatty acid acetylenases, lipoxygenases, triacylglycerol lipases, allene oxide synthases, hydroperoxide lyases or fatty acid elongase(s) in the plant.

The invention furthermore relates to recombinant nucleic acid molecules comprising at least one nucleic acid sequence which codes for a polypeptide having a Δ6-desaturase activity; at least one nucleic acid sequence which codes for a polypeptide having a Δ5-desaturase activity; at least one nucleic acid sequence which codes for a polypeptide having a Δ6-elongase activity; and at least one nucleic acid sequence which codes for a polypeptide having a Δ5-elongase activity and which is modified by comparison with the nucleic acid sequence in the organism from which the sequence originates in that it is adapted to the codon usage in one or more plant species.

A further part of the invention relates to oils, lipids and/or fatty acids which have been produced by the process according to the invention, and to their use.

Finally, the invention also relates to transgenic plants which have been produced by the process of the invention or which comprise a recombinant nucleic acid molecule of the invention, and to the use thereof as foodstuffs or feedstuffs.

Lipid synthesis can be divided into two sections: the synthesis of fatty acids and their binding to sn-glycerol-3-phosphate, and the addition or modification of a polar head group. Usual lipids which are used in membranes comprise phospholipids, glycolipids, sphingolipids and phosphoglycerides. Fatty acid synthesis starts with the conversion of acetyl-CoA into malonyl-CoA by acetyl-CoA carboxylase or into acetyl-ACP by acetyl transacylase. After condensation reaction, these two product molecules together form acetoacetyl-ACP, which is converted via a series of condensation, reduction and dehydration reactions so that a saturated fatty acid molecule with the desired chain length is obtained. The production of the unsaturated fatty acids from these molecules is catalyzed by specific desaturases, either aerobically by means of molecular oxygen or anaerobically (regarding the fatty acid synthesis in microorganisms, see F. C. Neidhardt et al. (1996) E. coli and Salmonella. ASM Press: Washington, D.C., p. 612-636 and references cited therein; Lengeler et al. (Ed.) (1999) Biology of Procaryotes. Thieme: Stuttgart, New York, and the references therein, and Magnuson, K., et al. (1993) Microbiological Reviews 57:522-542 and the references therein). To undergo the further elongation steps, the resulting phospholipid-bound fatty acids must be returned to the fatty acid CoA ester pool. This is made possibly by acyl-CoA:lysophospholipid acyltransferases. Moreover, these enzymes are capable of transferring the elongated fatty acids from the CoA esters back to the phospholipids. If appropriate, this reaction sequence can be followed repeatedly.

Furthermore, fatty acids must subsequently be transported to various modification sites and incorporated into the triacylglycerol storage lipid. A further important step during lipid synthesis is the transfer of fatty acids to the polar head groups, for example by glycerol fatty acid acyltransferase (see Frentzen, 1998, Lipid, 100(4-5):161-166).

An overview of the biosynthesis of fatty acids in plants, desaturation, the lipid metabolism and the membrane transport of lipidic compounds, beta-oxidation, the modification of fatty acids, cofactors and the storage and assembly of triacylglycerol, including the references is given by the following papers: Kinney (1997) Genetic Engineering, Ed.: J K Setlow, 19:149-166; Ohlrogge and Browse (1995) Plant Cell 7:957-970; Shanklin and Cahoon (1998) Annu. Rev. Plant Physiol. Plant Mol. Biol. 49:611-641; Voelker (1996) Genetic Engeneering, Ed.: J K Setlow, 18:111-13; Gerhardt (1992) Prog. Lipid R. 31:397-417; Gühnemann-Schafer & Kindl (1995) Biochim. Biophys Acta 1256:181-186; Kunau et al. (1995) Prog. Lipid Res. 34:267-342; Stymne et al. (1993) in: Biochemistry and Molecular Biology of Membrane and Storage Lipids of Plants, Ed.: Murata and Somerville, Rockville, American Society of Plant Physiologists, 150-158; Murphy & Ross (1998) Plant Journal. 13(1):1-16.

Depending on the desaturation pattern, two large classes of polyunsaturated fatty acids, the ω6 and the ω3 fatty acids; which differ with regard to their metabolism and their function, can be distinguished.

In the text which follows, polyunsaturated fatty acids are referred to as PUPA, PUFAs, LCPUFA or LCPUFAs (poly unsaturated fatty acids, PUFA, long chain poly unsaturated fatty acids, LCPUFA).

The fatty acid linoleic acid ($18:2^{\Delta 9,12}$) acts as starting material for the ω6 metabolic pathway, while the ω3 pathway proceeds via linolenic acid ($18:3^{\Delta 9,12,15}$). Linolenic acid is formed from linoleic acid by the activity of an ω3-desaturase (Tocher et al. (1998) Prog. Lipid Res. 37: 73-117; Domergue et al. (2002) Eur. J. Biochem. 269: 4105-4113).

Mammals, and thus also humans, have no corresponding desaturase activity (Δ12- and ω3-desaturase) for the formation of the starting materials and must therefore take up these fatty acids (essential fatty acids) via the food. Starting with these precursors, the physiologically important polyunsaturated fatty acids arachidonic acid (=ARA, 20:4$^{Δ5,8,11,14}$), an ω6-fatty acid and the two ω3-fatty acids eicosapentaenoic acid (=EPA, 20:5$^{Δ5,8,11,14,17}$) and docosahexaenoic acid (DHA, 22:6$^{Δ4,7,10,13,17,19}$) are synthesized via a sequence of desaturase and elongase reactions.

The elongation of fatty acids, by elongases, by 2 or 4 C atoms is of crucial importance for the production of $C_{20}$- and $C_{22}$-PUFAs, respectively. This process proceeds via 4 steps. The first step is the condensation of malonyl-CoA onto the fatty acid acyl-CoA by ketoacyl-CoA synthase (KCS, hereinbelow referred to as elongase). This is followed by a reduction step (ketoacyl-CoA reductase, KCR), a dehydratation step (dehydratase) and a final reduction step (enoyl-CoA reductase). It has been postulated that the elongase activity affects the specificity and rate of the entire process (Millar and Kunst (1997) Plant Journal 12:121-131).

Fatty acids and triacylglycerides have a multiplicity of applications in the food industry, in animal nutrition, in cosmetics and the pharmacological sector. Depending on whether they are free saturated or unsaturated fatty acids or else triacylglycerides with an elevated content of saturated or unsaturated fatty acids, they are suitable for very different applications. Thus, for example, lipids with unsaturated, specifically with polyunsaturated fatty acids, are preferred in human nutrition. The polyunsaturated ω3-fatty acids are supposed to have a positive effect on the cholesterol level in the blood and thus on the prevention of heart disease. The risk of heart disease, strokes or hypertension can be reduced markedly by adding these ω3-fatty acids to the food (Shimikawa (2001) World Rev. Nutr. Diet. 88: 100-108).

ω3-fatty acids also have a positive effect on inflammatory, specifically on chronically inflammatory, processes in association with immunological diseases such as rheumatoid arthritis (Calder (2002) Proc. Nutr. Soc. 61: 345-358; Cleland and James (2000) J. Rheumatol. 27: 2305-2307). They are therefore added to foodstuffs, specifically to dietetic foodstuffs, or are employed in medicaments. ω6-fatty acids such as arachidonic acid tend to have a negative effect in connection with these rheumatological diseases.

ω3- and ω6-fatty acids are precursors of tissue hormones, known as eicosanoids, such as the prostaglandins, which are derived from dihomo-γ-linolenic acid, arachidonic acid and eicosapentaenoic acid, and of the thromboxanes and leukotrienes, which are derived from arachidonic acid and eicosapentaenoic acid. Eicosanoids (known as the $PG_2$ series) which are formed from the Ω6-fatty acids, generally promote inflammatory reactions, while eicosanoids (known as the $PG_3$ series) from Ω3-fatty acids have little or no proinflammatory effect.

Polyunsaturated long-chain Ω3-fatty acids such as eicosapentaenoic acid (=EPA, C20:5$^{Δ5,8,11,14,17}$) or docosahexaenoic acid (=DHA, C22:6$^{Δ4,7,10,13,16,19}$) are important components of human nutrition owing to their various roles in health aspects, including the development of the child brain, the functionality of the eyes, the synthesis of hormones and other signal substances, and the prevention of cardiovascular disorders, cancer and diabetes (Poulos, A (1995) Lipids 30:1-14; Horrocks, L A and Yeo Y K (1999) Pharmacol Res 40:211-225).

Owing to the present-day composition of human food, an addition of polyunsaturated ω3-fatty acids, which are preferentially found in fish oils, to the food is particularly important. Thus, for example, polyunsaturated fatty acids such as docosahexaenoic acid (=DHA, C22:6$^{Δ4,7,10,13,16,19}$) or eicosapentaenoic acid (=EPA, C20:5$^{Δ5,8,11,14,17}$) are added to infant formula to improve the nutritional value. There is therefore a demand for the production of polyunsaturated long-chain fatty acids.

The various fatty acids and triglycerides are mainly obtained from microorganisms such as *Mortierella* or *Schizochytrium* or from oil-producing plants such as soybeans, oilseed rape, and algae such as *Crypthecodinium* or *Phaeodactylum* and others, being obtained, as a rule, in the form of their triacylglycerides (=triglycerides=triglycerols). However, they can also be obtained from animals, for example, fish. The free fatty acids are advantageously prepared by hydrolyzing the triacylglycerides. Very long-chain polyunsaturated fatty acids such as DHA, EPA, arachidonic acid (ARA, C20:4$^{Δ5,8,11,14}$), dihomo-γ-linolenic acid (DHGL, C20:3$^{Δ8,11,14}$) or docosapentaenoic acid (DPA, C22:5$^{Δ7,10,13,16,19}$) are, however, not synthesized in oil crops such as oilseed rape, soybeans, sunflowers and safflower. Conventional natural sources of these fatty acids are fish such as herring, salmon, sardine, redfish, eel, carp, trout, halibut, mackerel, zander or tuna, or algae.

Owing to the positive characteristics of the polyunsaturated fatty acids, there has been no lack of attempts in the past to make available genes which are involved in the synthesis of these fatty acids or triglycerides for the production of oils in various organisms with a modified content of unsaturated fatty acids. Thus, WO 91/13972 and its US equivalent describe a Δ9-desaturase. WO 93/11245 claims a Δ15-desaturase and WO 94/11516 a Δ12-desaturase. Further desaturates are described, for example, in EPA-0 550 162, WO 94/18337, WO 97/30582, WO 97/21340, WO 95/18222, EPA-0 794 250, Stukey et al. (1990) J. Biol. Chem., 265: 20144-20149, Wada et al. (1990) Nature 347: 200-203 or Huang et al. (1999) Lipids 34: 649-659. However, the biochemical characterization of the various desaturases has been insufficient to date since the enzymes, being membrane-bound proteins, present great difficulty in their isolation and characterization (McKeon et al. (1981) Methods in Enzymol. 71: 12141-12147, Wang et al. (1988) Plant Physiol. Biochem., 26: 777-792).

As a rule, membrane-bound desaturases are characterized by being introduced into a suitable organism which is subsequently analyzed for enzyme activity by analyzing the starting materials and the products. Δ6-Desaturases are described in WO 93/06712, U.S. Pat. No. 5,614,393, WO 96/21022, WO 00/21557 and WO 99/27111. The application of this enzyme for the production of fatty acids in transgenic organisms is described in WO 98/46763, WO 98/46764 and WO 98/46765. The expression of various desaturases and the formation of polyunsaturated fatty acids is also described and claimed in WO 99/64616 or WO 98/46776. As regards the expression efficacy of desaturases and its effect on the formation of polyunsaturated fatty acids, it must be noted that the expression of a single desaturase as described to date has only resulted in low contents of unsaturated fatty acids/ lipids such as, for example, γ-linolenic acid and stearidonic acid.

There have been a number of attempts in the past to obtain elongase genes. Millar and Kunst (1997) Plant Journal 12:121-131 and Millar et al. (1999) Plant Cell 11:825-838 describe the characterization of plant elongases for the synthesis of monounsaturated long-chain fatty acids (C22:1)

and for the synthesis of very long-chain fatty acids for the formation of waxes in plants ($C_{25}$-$C_{32}$). The synthesis of arachidonic acid and EPA is described, for example, in WO 01/59128, WO 00/12720, WO 02/077213 and WO 02/08401. The synthesis of polyunsaturated C24-fatty acids is described, for example, in Tvrdik et al. (2000) J. Cell Biol. 149:707-718 or in WO 02/44320.

Especially suitable microorganisms for the production of PUFAs are microalgae such as *Phaeodactylum tricornutum, Porphiridium* species, *Thraustochytrium* species, *Schizochytrium* species or *Crypthecodinium* species, ciliates such as *Stylonychia* or *Colpidium*, fungi such as *Mortierella, Entomophthora* or *Mucor* and/or mosses such as *Physcomitrella, Ceratodon* and *Marchantia* (R. Vazhappilly & F. Chen (1998) Botanica Marina 41: 553-558; K. Totani & K. Oba (1987) Lipids 22: 1060-1062; M. Akimoto et al. (1998) Appl. Biochemistry and Biotechnology 73: 269-278). Strain selection has resulted in the development of a number of mutant strains of the microorganisms in question which produce a series of desirable compounds including PUFAs. However, the mutation and selection of strains with an improved production of a particular molecule such as the polyunsaturated fatty acids is a time-consuming and difficult process. Moreover, only limited amounts of the desired polyunsaturated fatty acids such as DPA, EPA or ARA can be produced with the aid of the abovementioned microorganisms; in addition, they are generally obtained as fatty acid mixtures. This is why recombinant methods are preferred whenever possible.

Higher plants comprise polyunsaturated fatty acids such as linoleic acid (C18:2) and linolenic acid (C18:3). ARA, EPA and DHA are found not at all in the seed oil of higher plants, or only in miniscule amounts (E. Ucciani: Nouveau Dictionnaire des Huiles Végétales [New Dictionary of the Vegetable Oils]. Technique & Documentation—Lavoisier, 1995. ISBN: 2-7430-0009-0). However, the production of LCPUFAs in higher plants, preferably in oil crops such as oilseed rape, linseed, sunflowers and soybeans, would be advantageous since large amounts of high-quality LCPUFAs for the food industry, animal nutrition and pharmaceutical purposes might be obtained economically. To this end, it is advantageous to introduce, into oilseeds, genes which encode enzymes of the LCPUFA biosynthesis via recombinant methods and to express them therein. These genes encode for example Δ6-desaturases, Δ6-elongases, Δ5-desaturases or Δ4-desaturases. These genes can advantageously be isolated from microorganisms and lower plants which produce LCPUFAs and incorporate them in the membranes or triacylglycerides. Thus, it has already been possible to isolate Δ6-desaturase genes from the moss *Physcomitrella patens* and Δ6-elongase genes from *P. patens* and from the nematode *C. elegans*.

Transgenic plants which comprise and express genes encoding LCPUFA biosynthesis enzymes and which, as a consequence, produce LCPUFAs have been described, for example, in DE-A-102 19 203 (process for the production of polyunsaturated fatty acids in plants).

However, these plants produce LCPUFAs in amounts which require further optimization for processing the oils which are present in the plants. Thus, the ARA content in the plants described in DE-A-102 19 203 is only 0.4 to 2% and the EPA content only 0.5 to 1%, in each case based on the total lipid content of the plant.

To make possible the fortification of food and of feed with polyunsaturated, long-chain fatty acids, there is therefore a great need for a simple, inexpensive process for the production of polyunsaturated, long-chain fatty acids, specifically in plant systems.

One object of the invention is therefore to provide a process with which long-chain polyunsaturated fatty acids, especially eicosapentaenoic acid, docosapentaenoic acid and/or docosahexaenoic acid can be produced in large quantities and inexpensively in transgenic plants.

It has now surprisingly been found that the yield of long-chain polyunsaturated fatty acids, especially eicosapentaenoic, docosapentaenoic acid and/or docosahexaenoic acid, can be increased by expressing an optimized Δ5-elongase sequence in transgenic plants.

The PUFAs produced by the process of the invention comprise a group of molecules which higher animals are no longer able to synthesize and thus must consume, or which higher animals are no longer able to produce themselves in sufficient amounts and thus must consume additional amounts thereof, although they can easily be synthesized by other organisms such as bacteria.

Accordingly, the object of the invention is achieved by the process of the invention for producing eicosapentaenoic acid, docosapentaenoic acid and/or docosahexaenoic acid in a transgenic plant, comprising the provision in the plant of at least one nucleic acid sequence which codes for a polypeptide having a Δ6-desaturase activity; at least one nucleic acid sequence which codes for a polypeptide having a Δ6-elongase activity; at least one nucleic acid sequence which codes for a polypeptide having a Δ5-desaturase activity; and at least one nucleic acid sequence which codes for a polypeptide having a Δ5-elongase activity, where the nucleic acid sequence which codes for a polypeptide having a Δ5-elongase activity is modified by comparison with the nucleic acid sequence in the organism from which the sequence is derived in that it is adapted to the codon usage in one or more plant species. To produce DHA it is additionally necessary to provide at least one nucleic acid sequence which codes for a polypeptide having a Δ4-desaturase activity in the plant.

The "provision in the plant" means in the context of the present invention that measures are taken so that the nucleic acid sequences coding for a polypeptide having a Δ6-desaturase activity, a polypeptide having a Δ6-elongase activity, a polypeptide having a Δ5-desaturase activity and a polypeptide having a Δ5-elongase activity are present together in one plant. The "provision in the plant" thus comprises the introduction of the nucleic acid sequences into the plant both by transformation of a plant with one or more recombinant nucleic acid molecules which comprise said nucleic acid sequences, and by crossing suitable parent plants which comprise one or more of said nucleic acid sequences.

The nucleic acid sequence which codes for a polypeptide having a Δ5-elongase activity is modified according to the invention by comparison with the nucleic acid sequence in the organism from which the sequence originates in that it is adapted to the codon usage in one or more plant species. This means that the nucleic acid sequence has been specifically optimized for the purpose of the invention without the amino acid sequence encoded by the nucleic acid sequence having been altered thereby.

The genetic code is redundant because it uses 61 codons in order to specify 20 amino acids. Therefore, most of the 20 proteinogenic amino acids are therefore encoded by a plurality of triplets (codons). The synonymous codons which specify an individual amino acid are, however, not used with the same frequency in a particular organism; on the contrary there are preferred codons which are frequently used, and codons which are used more rarely. These differences in codon usage are attributed to selective evolutionary pressures and especially the efficiency of translation. One reason for the lower translation efficiency of rarely occurring codons might be that the corresponding aminoacyl-tRNA pools are exhausted and thus no longer available for protein synthesis.

In addition, different organisms prefer different codons. For this reason, for example, the expression of a recombinant DNA derived from a mammalian cell frequently proceeds only suboptimally in *E. coli* cells. It is therefore possible in some cases to increase expression by replacing rarely used codons with frequently used codons. Without wishing to be bound to one theory, it is assumed that the codon-optimized DNA sequences make more efficient translation possible, and the mRNAs formed therefrom possibly have a greater half-life in the cell and therefore are available more frequently for translation. From what has been said above, it follows that codon optimization is necessary only if the organism in which the nucleic acid sequence is to be expressed differs from the organism from which the nucleic acid sequence is originally derived.

For many organisms of which the DNA sequence of a relatively large number of genes is known there are tables from which the frequency of use of particular codons in the respective organism can be taken. It is possible with the aid of these tables to translate protein sequences with relatively high accuracy back into a DNA sequence which comprises the codons preferred in the respective organism for the various amino acids of the protein. Tables on codon usage can be found inter alia at the following Internet address: www.kazusa.or.jp/Kodon/E.html. In addition, several companies provide software for gene optimization, such as, for example, Entelechon (Software Leto) or Geneart (Software GeneOptimizer).

Adaptation of the sequences to the codon usage in a particular organism can take place with the aid of various criteria. On the one hand, it is possible to use for a particular amino acid always the codon which occurs most frequently in the selected organism but, on the other hand, the natural frequency of the various codons can also be taken into account, so that all the codons for a particular amino acid are incorporated into the optimized sequence according to their natural frequency. Selection of the position at which a particular base triplet is used can take place at random in this case. The DNA sequence was adapted according to the invention taking account of the natural frequency of individual codons, it also being suitable to use the codons occurring most frequently in the selected organism.

It is particularly preferred for a nucleic acid sequence from *Ostreococcus tauri* which codes for a polypeptide having a Δ5-elongase activity, such as, for example, the polypeptide depicted in SEQ ID NO: 110, to be adapted at least to the codon usage in oilseed rape, soybean and/or flax. The nucleic acid sequence originally derived from *Ostreococcus tauri* is preferably the sequence depicted in SEQ ID NO: 109. The DNA sequence coding for the Δ5-elongase is adapted in at least 20% of the positions, preferably in at least 30% of the positions, particularly preferably in at least 40% of the positions and most preferably in at least 50% of the positions to the codon usage in oilseed rape, soybean and/or flax.

The nucleic acid sequence used is most preferably the sequence indicated in SEQ ID NO: 64.

It will be appreciated that the invention also encompasses those codon-optimized DNA sequences which code for a polypeptide having the activity of a Δ5-elongase and whose amino acid sequence is modified in one or more positions by comparison with the wild-type sequence but which still has substantially the same activity as the wild-type protein.

The nucleic acid sequence which codes for a polypeptide having a Δ6-desaturase activity is preferably selected from the group consisting of:

a) nucleic acid sequences having the sequence depicted in SEQ ID NO: 1, 3, 5, 7, 9, 11, 13, 15, 17, 19, 21, 23, 25, 27, 29, 31, 33, 35, 37, 39 or 41, preferably having the sequence depicted in SEQ ID NO: 1, b) nucleic acid sequences which code for the amino acid sequence indicated in SEQ ID NO: 2, 4, 6, 8, 10, 12, 14, 16, 18, 20, 22, 24, 26, 28, 30, 32, 34, 36, 38, 40 or 42, preferably in SEQ ID NO: 2, c) nucleic acid sequences which hybridize with the complementary strand of the nucleic acid sequences indicated a) or b) above, in particular of the nucleic acid sequence indicated in SEQ ID NO: 1, under stringent conditions, d) nucleic acid sequences which are at least 60%, 65%, 70%, 75% or 80%, preferably at least 81%, 82%, 83%, 84%, 85%, 86%, 87%, 88%, 89% or 90%, particularly preferably at least 91%, 92%, 93%, 94% or 95% and especially at least 96%, 97%, 98% or 99%, identical to the nucleic acid sequences indicated in a) or b) above, especially to the sequence indicated in SEQ ID NO: 1, and e) nucleic acid sequences which code for an amino acid sequence and which have at least one, for example 2, 3, 4, 5, 6, 7 or 8, preferably all of the amino acid pattern indicated in SEQ ID NO: 43, 44, 45, 46, 47, 48, 49 or 50.

Amino acid pattern means short amino acid sequences which preferably comprise less than 50, particularly preferably less than 40 and especially from 10 to 40 and even more preferably from 10 to 30 amino acids.

For the present invention, the identity is ascertained preferably over the full length of the nucleotide or amino acid sequences of the invention, for example for the nucleic acid sequence indicated in SEQ ID NO: 64 over the full length of 903 nucleotides.

The nucleic acid sequence which codes for a polypeptide having a Δ-elongase activity is preferably selected from the group consisting of:

a) nucleic acid sequences having the sequence depicted in SEQ ID NO: 171, 173, 175, 177, 179, 181 or 183, especially having the sequence depicted in SEQ ID NO: 171, b) nucleic acid sequences which code for the amino acid sequence indicated in SEQ ID NO: 172, 174, 176, 178, 180, 182 or 184, especially for the amino acid sequence indicated in SEQ ID NO: 172, c) nucleic acid sequences which hybridize with the complementary strand of the nucleic acid sequences indicated a) or b) above, especially of the nucleic acid sequence indicated in SEQ ID NO: 1, under stringent conditions, d) nucleic acid sequences which are at least 60%, 65%, 70%, 75% or 80%, preferably at least 81%, 82%, 83%, 84%, 85%, 86%, 87%, 88%, 89% or 90%, particularly preferably at least 91%, 92%, 93%, 94% or 95% and especially at least 96%, 97%, 98% or 99%, identical to the nucleic acid sequences indicated in a) or b) above, especially to the sequence indicated in SEQ ID NO: 171, and e) nucleic acid sequences which code for an amino acid sequence and which have at least one, for example 2, 3, 4, 5, 6, 7 or 8, preferably all of the amino acid pattern indicated in SEQ ID NO: 185, 186, 187, 188, 189, 190, 191 or 192.

The nucleic acid sequence which codes for a polypeptide having a Δ6-elongase activity is in particular likewise a codon-optimized sequence according to the present invention, preferably the nucleic acid sequence depicted in SEQ ID NO: 122.

The nucleic acid sequence which codes for a polypeptide having a Δ5-desaturase activity is preferably selected from the group consisting of:

a) nucleic acid sequences having the sequence depicted in SEQ ID NO: 51, 53 or 55, preferably having the sequence depicted in SEQ ID NO: 51,
b) nucleic acid sequences which code for the amino acid sequence indicated in SEQ ID NO: 52, 54 or 56, preferably for the amino acid sequence indicated in SEQ ID NO: 52,
c) nucleic acid sequences which hybridize with the complementary strand of the nucleic acid sequences indicated in a) or b) above, especially of the nucleic acid sequence indicated in SEQ ID NO: 51, under stringent conditions,
d) nucleic acid sequences which are at least 60%, 65%, 70%, 75% or 80%, preferably at least 81%, 82%, 83%, 84%, 85%, 86%, 87%, 88%, 89% or 90%, particularly preferably at least 91%, 92%, 93%, 94% or 95% and especially at least 96%, 97%, 98% or 99%, identical to the nucleic acid sequences indicated in a) or b) above, especially to the nucleic acid indicated under SEQ ID NO: 51, and
e) nucleic acid sequences which code for an amino acid sequence which have at least one, for example 2, 3, 4, 5, 6 or 7, preferably all of the amino acid pattern indicated in SEQ ID NO: 57, 58, 59, 60, 61, 62 or 63.

Further suitable nucleic acid sequences can be found by the skilled worker from the literature or the well-known gene libraries such as, for example, www.ncbi.nlm.nih.gov.

The nucleic acid sequence which codes for a polypeptide having an ω-3-desaturase activity is preferably selected from the group consisting of:

a) nucleic acid sequences having the sequence depicted in SEQ ID NO: 193 or 195, preferably the sequence depicted in SEQ ID NO: 193,
b) nucleic acid sequences which code for the amino acid sequence indicated in SEQ ID NO: 194,
c) nucleic acid sequences which hybridize with the complementary strand of the nucleic acid sequence indicated in SEQ ID NO: 193 or 195 under stringent conditions, and
d) nucleic acid sequences which are at least 60%, 65%, 70%, 75% or 80%, preferably at least 81%, 82%, 83%, 84%, 85%, 86%, 87%, 88%, 89% or 90%, particularly preferably at least 91%, 92%, 93%, 94% or 95%, and especially at least 96%, 97%, 98% or 99%, identical to the sequence indicated in SEQ ID NO: 193 or 195.

The ω-3-desaturase advantageously used in the process of the invention makes it possible to shift from the ω-6 biosynthetic pathway to the ω-3 biosynthetic pathway, leading to a shift from $C_{18:2}$ to $C_{18:3}$ fatty acids. It is further advantageous for the ω-3-desaturase to convert a wide range of phospholipids such as phosphatidylcholine (=PC), phosphatidylinositol (=PIS) or phosphatidylethanolamine (=PE). Finally, desaturation products can also be found in the neutral lipids (=NL), that is to say in the triglycerides.

The nucleic acid sequence which codes for a polypeptide having a Δ4-desaturase activity is preferably selected from the group consisting of:

a) nucleic acid sequences having the sequence depicted in SEQ ID NO: 77, 79, 81, 83, 85, 87, 89, 91 or 93, preferably having the sequence depicted in SEQ ID NO: 77,
b) nucleic acid sequences which code for the amino acid sequence indicated in SEQ ID NO: 78, 80, 82, 84, 86, 88, 90, 92 or 94, preferably for the amino acid sequence indicated in SEQ ID NO: 78,
c) nucleic acid sequences which hybridize with the complementary strand of the nucleic acid sequences indicated in a) or b) above, especially of the nucleic acid sequence indicated in SEQ ID NO: 77, under stringent conditions,
d) nucleic acid sequences which are at least 60%, 65%, 70%, 75% or 80%, preferably at least 81%, 82%, 83%, 84%, 85%, 86%, 87%, 88%, 89% or 90%, particularly preferably at least 91%, 92%, 93%, 94% or 95% and especially at least 96%, 97%, 98% or 99%, identical to the sequence indicated in SEQ ID NO: 77, and
e) nucleic acid sequences which code for an amino acid sequence which have at least one, for example 2, 3, 4, 5, 6, 7, 8, 9, 10, 11, 12, 13 or 14, preferably all of the amino acid pattern indicated in SEQ ID NO: 95, 96, 97, 98, 99, 100, 101, 102, 103, 104, 105, 106, 107 or 108.

The Δ4-desaturase which is advantageously used in the process of the invention catalyzes the introduction of a double bond into the fatty acid docosapentaenoic acid, leading to formation of docosahexaenoic acid.

It is advantageous for the described process of the invention additionally to introduce further nucleic acids which code for enzymes of fatty acid or lipid metabolism into the plants in addition to the nucleic acid sequences which code for polypeptides having a Δ6-desaturase activity, a M-elongase activity, a Δ5-desaturase activity and a Δ5-elongase activity, and to the nucleic acid sequences which are introduced if appropriate and which code for a polypeptide having an ω-3-desaturase activity and/or a Δ4-desaturase activity.

It is possible in principle to use all genes of fatty acid or lipid metabolism in combination with the nucleic acid sequences used in the process of the invention; genes of fatty acid or lipid metabolism selected from the group of acyl-CoA dehydrogenase(s), acyl-ACP (acyl carrier protein) desaturase(s), acyl-ACP thioesterase(s), fatty acid acyltransferase(s), acyl-CoA:lysophospholipid acyltransferases, fatty acid synthase(s), fatty acid hydroxylase(s), acetyl-coenzyme A carboxylase(s), acyl-coenzyme A oxidase(s), fatty acid desaturase(s), fatty acid acetylenases, lipoxygenases, triacylglycerol lipases, allene oxide synthases, hydroperoxide lyases or fatty acid elongase(s) are preferably used in combination with the Δ-6-elongase, Δ-6-desaturase, Δ-5-desaturase and the Δ-5-elongase, and if appropriate the ω-3-desaturase and/or the Δ-4-desaturase, it being possible to use individual genes or a plurality of genes in combination.

The nucleic acids used in the process of the invention are advantageously expressed in vegetative tissues (somatic tissue). Vegetative tissue means in the context of this invention a tissue which is propagated through mitotic divisions. Tissue of this type also arises through asexual reproduction (apomixis) and propagation. Propagation is the term used when the number of individuals increases in consecutive generations. These individuals arising through asexual propagation are very substantially identical to their parents. Examples of such tissues are leaf, flower, root, stalk, runners above or below ground (side shoots, stolons), rhizomes, buds, tubers such as root tubers or stem tubers, bulb, brood bodies, brood buds, bulbuls or turion. Such tissues may also arise through pseudo vivipary, true vivipary or vivipary caused by humans. However, seeds arising through agamospermy, as are typical of Asteraceae, Poaceae or Rosaceae, are also included among the vegetative tissues in which expression advantageously takes place. The nucleic acids used in the process of the invention are expressed to a small extent or not at all in generative tissue (germ line tissue). Examples of such tissues are tissues arising through sexual reproduction, i.e. meiotic cell divisions, such as, for example, seeds arising through sexual processes.

A small extent means that, compared with vegetative tissue, the expression measured at the RNA and/or protein level is less than 5%, advantageously less than 3%, particularly advantageously less than 2%, most preferably less than 1; 0.5; 0.25 or 0.125%.

The nucleic acid sequences are particularly preferably expressed in the leaves of the transgenic plants. This has the advantage that the LCPUFAs produced according to the invention can be taken in by animals and humans directly by consuming the leaves, and no previous processing of the plant material is necessary.

Expression of the nucleic acid sequences of the invention in the leaf can be achieved by using constitutive or leaf-specific promoters.

"Constitutive promoters" are promoters which make expression possible in a large number of, preferably in all, tissues over a substantial period during plant development, preferably throughout plant development. A promoter from a plant or from a plant virus is preferably used. The promoter of the CaMV (cauliflower mosaic virus) 35S transcript (Franck et al. (1980) Cell 21: 285-294), the 19S CaMV promoter (U.S. Pat. No. 5,352,605), the actin promoter from rice (McElroy et al. (1990) Plant Cell 2: 163-171), the legumin B promoter (GenBank Acc. No. X03677), the *agrobacterium* nopaline synthase promoter, the TR dual promoter, the *agrobacterium* octopine synthase promoter, the ubiquitin promoter (Holtorf et al. (1995) Plant Mol. Biol. 29: 637-649), the Smas promoter, the cinnamoyl alcohol dehydrogenase promoter (U.S. Pat. No. 5,683,439), the promoters of the vacuolar ATPase subunits, the pEMU promoter (Last et al. (1991) Theor. Appl. Genet. 81: 581-588), the MAS promoter (Yellen et al. (1984) EMBO J. 3(12): 2723-2730), the histone H3 promoter from corn (Lepetit et al. (1992) Mol. Gen. Genet. 231: 276-285), the promoter of the nitrilase 1 gene from *arabidopsis* (GenBank Acc. No. U38846, nucleotides 3862-5325) and the promoter of a proline-rich protein from wheat (WO 91/13991) and further promoters which mediate constitutive gene expression. The promoter of the CaMV 35S transcript is particularly preferred.

It is in principle possible to use all naturally occurring constitutive promoters with their regulatory sequences like those mentioned above for the novel process. However, it is likewise possible to use synthetic promoters in addition or alone.

"Leaf-specific promoters" are promoters which show a high activity in the leaf and no or only low activity in other tissues. "Low activity" means in the context of the invention that the activity in other tissues is less than 20%, preferably less than 10%, particularly preferably less than 5% and most preferably less than 3, 2 or 1% of the activity in the leaf. Examples of suitable leaf-specific promoters are the promoters of the small subunit of rubisco (Timko et al. (1985) Nature 318: 579-582) and of the chlorophyll a/b-binding protein (Simpson et al. (1985) EMBO J. 4: 2723-2729).

The skilled worker is aware of further leaf-specific promoters, or he can isolate further suitable promoters with known methods. Thus, the skilled worker is able to identify leaf-specific regulatory nucleic acid elements with the aid of conventional methods of molecular biology, e.g. hybridization experiments or DNA-protein binding studies. This entails for example in a first step isolating the total poly(A)$^+$ RNA from leaf tissue of the desired organism from which the regulatory sequences are to be isolated, and setting up a cDNA library. In a second step, cDNA clones which are based on poly(A)$^+$ RNA molecules from a non-leaf tissue are used to identify, by means of hybridization, those clones from the first library whose corresponding poly(A)$^+$ RNA molecules accumulate only in leaf tissue. Subsequently, these cDNAs identified in this way are used to isolate promoters which have leaf-specific regulatory elements. Further PCR-based methods for isolating suitable leaf-specific promoters are additionally available to the skilled worker.

It is, of course, also possible for the nucleic acid sequences of the present invention to be expressed in the seeds of the transgenic plants by using seed-specific promoters which are active in the embryo and/or in the endosperm. Seed-specific promoters can in principle be isolated both from dicotyledonous and from monocotyledonous plants. Preferred promoters are listed hereinafter: USP (unknown seed protein) and vicilin (*Vicia faba*) (Bäumlein et al. (1991) Mol. Gen. Genet. 225(3): 459-467), napin (oilseed rape) (U.S. Pat. No. 5,608,152), conlinin (flax) (WO 02/102970), acyl-carrier protein (oilseed rape) (U.S. Pat. No. 5,315,001 and WO 92/18634), oleosin (*Arabidopsis thaliana*) (WO 98/45461 and WO 93/20216), phaseolin (*Phaseolus vulgaris*) (U.S. Pat. No. 5,504,200), Bce4 (WO 91/13980), legume B4 (LegB4 promoter) (Bäumlein et al. (1992) Plant J. 2(2): 233-239), Lpt2 and lpt1 (barley) (WO 95/15389 and WO 95/23230), seed-specific promoters from rice, corn and wheat (WO 99/16890), Amy32b, Amy 6-6 and aleurain (U.S. Pat. No. 5,677,474), Bce4 (oilseed rape) (U.S. Pat. No. 5,530,149), glycinin (soybean) (EP 571 741), phosphoenolpyruvate carboxylase (soybean) (JP 06/62870), ADR 12-2 (soybean) (WO 98/08962), isocitrate lyase (oilseed rape) (U.S. Pat. No. 5,689,040) α-amylase (barley) (EP 781 849), or ω3-desaturase (Fad3).

In a particularly preferred embodiment of the present invention, the nucleic acid sequences used, especially the nucleic acid sequence which codes for a Δ5-elongase and which is modified by comparison with the nucleic acid sequence in the organism from which the sequence originates by being adapted to the codon usage in one or more plant species, preferably the nucleic acid sequence described in SEQ ID NO: 64, are expressed in generative tissue, especially in the seed. Specific expression in the seed advantageously takes place by using one of the abovementioned seed-specific promoters, especially using the napin promoter. In this particularly preferred embodiment, the content of produced LCPUFAs, especially of the C22 fatty acids, in the seed oil is at least 5% by weight, advantageously at least 6, 7, 8, 9 or 10% by weight, preferably at least 11, 12, 13, 14 or 15% by weight, particularly preferably at least 16, 17, 18, 19 or 20% by weight, very particularly preferably at least 25, 30, 35 or 40% by weight, of the seed oil content. In a further particularly preferred embodiment with the nucleic acid sequence described in SEQ ID NO: 63, the content of C22 fatty acids in the seed oil is at least 8% by weight of the seed oil content.

In a further particularly preferred embodiment of the present invention, the nucleic acid sequences used, especially the nucleic acid sequence which codes for a Δ5-elongase and which is modified by comparison with the nucleic acid sequence in the organism from which the sequence originates by being adapted to the codon usage in one or more plant species, preferably the nucleic acid sequence described in SEQ ID NO: 64, are expressed in generative tissue, especially in the seed. Specific expression in the seed advantageously takes place by using one of the abovementioned seed-specific promoters, especially using the napin promoter. In this particularly preferred embodiment, the content of docosahexaenoic acid in the seed oil is at least 1% by weight, preferably at least 1.1, 1.2, 1.3, 1.4 or 1.5% by weight, particularly preferably at least 1.6, 1.7, 1.8 or 1.9% by weight, especially at least 2, 2.1, 2.2, 2.3, 2.4, 2.5, 2.6, 2.7, 2.8 or 2.9% by weight, further preferably at least 3, 3.5 or 4% by weight of the seed oil content. In a further particularly preferred embodiment with the nucleic acid sequence described in SEQ ID NO: 63, the content of docosahexaenoic acid in the seed oil is at least 1.9% by weight of the seed oil content. It is known to the skilled worker in this connection that to produce docosahexaenoic acid additionally one or more nucleic acid sequences which codes for a polypeptide having the activity of a Δ4-desaturase activity are required. A nucleic acid sequence which codes for a polypeptide having the activity of a Δ4-desaturase activity is advantageously selected from the group consisting of nucleic acid sequences having the sequence depicted in SEQ ID NO: 77, 79, 81, 83, 85, 87, 89, 91 or 93, preferably having the sequence depicted in SEQ ID NO: 77.

In a further particularly preferred embodiment of the present invention, the nucleic acid sequences used, especially the nucleic acid sequence which codes for a Δ5-elongase and which is modified by comparison with the nucleic acid sequence in the organism from which the nucleic acid sequence originates by being adapted to the codon usage in one or more plant species, preferably the nucleic acid sequence described in SEQ ID NO: 64, are expressed in generative tissue, especially in the seed. Specific expression in the seed advantageously takes place by using one of the abovementioned seed-specific promoters, especially using the napin promoter. In this particularly preferred embodiment, the content of docosahexaenoic acid in the seed oil is at least 1% by weight, preferably at least 1.1, 1.2, 1.3, 1.4 or 1.5% by weight, particularly preferably at least 1.6, 1.7, 1.8 or 1.9% by weight, especially at least 2, 2.1, 2.2, 2.5, 2.6, 2.7, 2.8 or 2.9% by weight, further preferably at least 3, 3.5 or 4% by weight of the seed oil content. In this case, the content of the produced LCPUFAs, especially of the C22 fatty acids, in the seed oil is at least 5% by weight, advantageously at least 6, 7, 8, 9 or 10% by weight, preferably at least 11, 12, 13, 14 or 15% by weight, particularly preferably at least 16, 17, 18, 19 or 20% by weight, very particularly preferably at least 25, 30, 35 or 40% by weight of the seed oil content. In a further particularly preferred embodiment with the nucleic acid sequence described in SEQ ID NO: 63, the content of docosahexaenoic acid in the seed oil is at least 1.9% by weight of the seed oil content, with the content of C22 fatty acids in the seed oil being at least 8% by weight of the seed oil content.

Plant gene expression can also be achieved via a chemically inducible promoter (see a review in Gatz (1997) Annu. Rev. Plant Physiol. Plant Mol. Biol., 48:89-108). Chemically inducible promoters are particularly suitable when it is desired that the gene expression takes place in a time-specific manner. Examples of such promoters are a salicylic-acid-inducible promoter (WO 95/19443), a tetracyclin-inducible promoter (Gatz et al. (1992) Plant J. 2, 397-404) and an ethanol-inducible promoter.

Promoters which respond to biotic or abiotic stress conditions are also suitable, for example the pathogen-induced PRP1 gene promoter (Ward et al., Plant. Mol. Biol. 22 (1993) 361-366), the heat-inducible tomato hsp80 promoter (U.S. Pat. No. 5,187,267), the chill-inducible potato alpha-amylase promoter (WO 96/12814) or the wound-inducible pinII promoter (EP-Δ-0 375 091).

Other promoters which are also particularly suitable are those which bring about the plastid-specific expression, since plastids constitute the compartment in which precursors and some end products of lipid biosynthesis are synthesized. Suitable promoters, such as the viral RNA polymerase promoter, are described in WO 95/16783 and WO 97/06250, and the *Arabidopsis* clpP promoter, described in WO 99/46394.

It will be appreciated that the polyunsaturated fatty acids produced according to the invention can be produced not only in intact transgenic plants but also in plant cell cultures or in callous cultures.

The polyunsaturated fatty acids produced in the process are advantageously bound in phospholipids and/or triacylglycerides, but may also occur as free fatty acids or else bound in the form of other fatty acid esters in the organisms. They may in this connection be present as "pure products" or else advantageously in the form of mixtures of various fatty acids or mixtures of different phospholipids such as phosphatidylglycerol, phosphatidylcholine, phosphatidylethanolamine and/or phosphatidylserine and/or triacylglycerides, monoacylglycerides and/or diacylglycerides. The LCPUFAs EPA, DPA and DHA produced in the process are advantageously present in phosphatidylcholine and/or phosphatidylethanolamine and/or in the triacylglycerides. The triacylglycerides may additionally also comprise further fatty acids such as short-chain fatty acids having 4 to 6 C atoms, medium-chain fatty acids having 8 to 12 C atoms or long-chain fatty acids having 14 to 24 C atoms. They preferably comprise long-chain fatty acids, particularly preferably $C_{20}$ or $C_{22}$ fatty acids.

The term "glyceride" is understood as meaning glycerol esterified with one, two or three carboxyl radicals (mono-, di- or triglyceride). "Glyceride" is also understood as meaning a mixture of various glycerides. The glyceride is preferably a triglyceride. The glyceride or glyceride mixture can comprise further additions, for example free fatty acids, antioxidants, proteins, carbohydrates, vitamins and/or other substances.

A "glyceride" for the purposes of the process according to the invention is furthermore understood as meaning derivatives which are derived from glycerol. In addition to the above-described fatty acid glycerides, these also include glycerophospholipids and glyceroglycolipids. Preferred examples which may be mentioned here are the glycerophospholipids such as lecithin (phosphatidylcholine), cardiolipin, phosphatidylglycerol, phosphatidylserine and alkylacylglycerophospholipids.

Phospholipids are to be understood as meaning, for the purposes of the invention, phosphatidylcholine, phosphatidylethanolamine, phosphatidylserine, phosphatidylglycerol and/or phosphatidylinositol.

The fatty acid esters with polyunsaturated $C_{18}$, $C_{20}$- and/or $C_{22}$-fatty acid molecules can be isolated in the form of an oil or lipid, for example in the form of compounds such as sphingolipids, phosphoglycerides, lipids, glycolipids such as glycosphingolipids, phospholipids such as phosphatidylethanolamine, phosphatidylcholine, phosphatidylserine, phosphatidylglycerol, phosphatidylinositol or diphosphatidylglycerol, monoacylglycerides, diacylglycerides, triacylglycerides or other fatty acid esters such as the acetyl-coenzyme A esters which comprise the polyunsaturated fatty acids with at least two, three or four, preferably four, five or six double bonds, from the useful plants which have been used for the preparation of the fatty acid esters; advantageously, they are isolated in the form of their diacylglycerides, triacylglycerides and/or in the form of the phosphatidyl ester, especially preferably in the form of the triacylglycerides, phosphatidylcholine and/or phosphatidylethanolamine.

In addition to these esters, the polyunsaturated fatty acids are also present in the plants as free fatty acids or bound in other compounds. As a rule, the various abovementioned compounds (fatty acid esters and free fatty acids) are present in the organisms with an approximate distribution of 80 to 90% by weight of triglycerides, 2 to 5% by weight of diglycerides, 5 to 10% by weight of monoglycerides, 1 to 5% by weight of free fatty acids, 2 to 8% by weight of phospholipids, the total of the various compounds amounting to 100% by weight.

The LCPUFAs produced in the process of the invention are produced with a content of at least 4% by weight, advantageously of at least 5, 6, 7, 8, 9 or 10% by weight, preferably of at least 11, 12, 13, 14 or 15% by weight, particularly preferably of at least 16, 17, 18, 19, or 20% by weight, very particularly preferably of at least 25, 30, 35 or 40% by weight based on the total fatty acids in the transgenic plant. The fatty acids EPA, DPA and/or DHA produced in the process of the invention are moreover present with a content of in each case at least 5% by weight, preferably of in each case at least 6, 7, 8 or 9% by weight, particularly preferably of in each case at least 10, 11 or 12% by weight, most preferably of in each case at least 13, 14, 15, 16, 17, 18, 19 or 20% by weight based on the total fatty acids in the transgenic plant.

The fatty acids are advantageously produced in bound form. It is possible with the aid of the nucleic acids used in the process of the invention for these unsaturated fatty acids to be put on the sn1, sn2 and/or sn3 position of the advantageously produced triacylglycerides. Advantageously, at least 11% of the triacylglycerides are doubly substituted (meaning on the sn1 and sn2 or sn2 and sn3 positions). Triply substituted triacylglycerides are also detectable. Since a plurality of reaction steps take place from the starting compounds linoleic acid (C18:2) and linolenic acid (C18:3), the final products of the process, such as, for example, arachidonic acid (ARA) or eicosapentaenoic acid (EPA), do not result as absolute pure products; traces or larger amounts of the precursors are always also present in the final product. If, for example, both linoleic acid and linolenic acid are present in the initial plant, the final products such as ARA or EPA and/or DPA and/or DHA are also present as mixtures. The precursors should advantageously amount to not more than 20% by weight, preferably not more than 15% by weight, particularly preferably not as 10% by weight, very particularly preferably not more than 5% by weight based on the amount of the respective final product. Advantageously, only ARA or EPA and/or DPA and/or DHA are produced in the process of the invention, bound or as free acids, as final products in a transgenic plant.

Fatty acid esters or fatty acid mixtures produced by the process of the invention advantageously comprise 6 to 15% palmitic acid, 1 to 6% stearic acid; 7-85% oleic acid; 0.5 to 8% vaccenic acid, 0.1 to 1% arachic acid, 7 to 25% saturated fatty acids, 8 to 85% monounsaturated fatty acids and 60 to 85% polyunsaturated fatty acids, in each case based on 100% and on the total fatty acid content of the organisms. Preferably at least 0.1; 0.2; 0.3; 0.4; 0.5; 0.6; 0.7; 0.8; 0.9 or 1% arachidonic acid in the total fatty acid content, are present as advantageous polyunsaturated fatty acid in the fatty acid ester or fatty acid mixtures. The fatty acid esters or fatty acid mixtures produced by the process of the invention further advantageously comprise fatty acids selected from the group of fatty acids erucic acid (13-docosaenoic acid), sterculic acid (9,10-methyleneoctadec-9-enonic acid), malvalic acid (8,9-methyleneheptadec-8-enonic acid), chaulmoogric acid (cyclopentenedodecanoic acid), furan fatty acid (9,12-epoxyoctadeca-9,11-dienonic acid), vernonic acid (9,10-epoxyoctadec-12-enonic acid), taric acid (6-octadecynonic acid), 6-nonadecynonic acid, santalbic acid (t11-octadecen-9-ynoic acid), 6,9-octadecenynonic acid, pyrulic acid (t10-heptadecen-8-ynonic acid), crepenynic acid (9-octadecen-12-ynoic acid) 13,14-dihydrooropheic acid, octadecen-13-ene-9,11-diynonic acid, petroselenic acid (cis-6-octadecenonic acid), 9c,12t-octadecadienoic acid, calendulic acid (8t10t12c-octadecatrienoic acid, catalpic acid (9t11t13c-octadecatrienoic acid), eleosteric acid (9c11t13t-octadecatrienoic acid), jacaric acid (8c10t12c-octadecatrienoic acid), punicic acid (9c11t13c-octadecatrienoic acid), parinaric acid (9c11t13t15c-octadecatetraenoic acid) pinolenic acid (all-cis-5,9,12-octadecatrienoic acid), laballenic acid (5,6-octadecadienallenic acid), ricinoleic acid (12-hydroxyoleic acid) and/or coriolic acid (13-hydroxy-9c,11t-octadecadienonic acid). In general, the aforementioned fatty acids are advantageously present only in traces in the fatty acid esters or fatty acid mixtures produced by the process of the invention, meaning that their occurrence, based on the total fatty acid content, is less than 30%, preferably less than 25%, 24%, 23%, 22% or 21%, particularly preferably less than 20%, 15%, 10%, 9%, 8%, 7%, 6% or 5%, very particularly preferably less than 4%, 3%, 2% or 1%. In a further preferred form of the invention the occurrence of these aforementioned fatty acids, based on the total fatty acids, is less than 0.9%; 0.8%; 0.7%; 0.6% or 0.5%, particularly preferably less than 0.4%; 0.3%; 0.2%; 0.1%. The fatty acid esters or fatty acid mixtures produced by the process of the invention advantageously comprise less than 0.1% based on the total fatty acids and/or no butyric acid, no cholesterol and no nisinic acid (tetracosahexaenoic acid, $C23:6^{\Delta 3,8,12,15,18,21}$).

It is possible through the nucleic acid sequences used in the process of the invention to achieve an increase in the yield of LCPUFAs in the transgenic plants of at least 50%, advantageously of at least 80%, particularly advantageously of at least 100%, very particularly advantageously of at least 150%, compared with the non-transgenic plants.

Chemically pure polyunsaturated fatty acids or fatty acid compositions can also be synthesized by the processes described above. To this end, the fatty acids or the fatty acid compositions are isolated from the plants in the known manner, for example via extraction, distillation, crystallization, chromatography or a combination of these methods. These chemically pure fatty acids or fatty acid compositions are advantageous for applications in the food industry sector, the cosmetic sector and especially the pharmacological industry sector.

In principle, all dicotyledonous or monocotyledonous useful plants are suitable for the process of the invention. Useful plants mean plants which serve to produce foods for humans and animals, to produce other consumables, fibers and pharmaceuticals, such as cereals, e.g. corn, rice, wheat, barley, millet, oats, rye, buckwheat; such as tubers, e.g. potato, cassava, sweet potato, yams etc.; such as sugar plants e.g. sugarcane or sugarbeet; such as legumes, e.g. beans, peas, broad bean etc.: such as oil and fat crops, e.g. soybean, oilseed rape, sunflower, safflower, flax, camolina etc., to mention only a few. Advantageous plants are selected from the group of plant families consisting of the families of Aceraceae, Actinidiaceae, Anacardiaceae, Apiaceae, Arecaceae, Asteraceae, Arecaceae, Betulaceae, Boraginaceae, Brassicaceae, Bromeliaceae, Cannabaceae, Cannaceae, Caprifoliaceae, Chenopodiaceae, Convolvulaceae, Cucurbitaceae, Dioscoreacea, Elaeagnaceae, Ericceae, Euphorbiaceae, Fabaceae, Fagaceae, Grossulariaceae, Juglandaceae, Lauraceae, Liliaceae, Linaceae, Malvaceae, Moraceae, Musaceae, Oleaceae, Oxalidaceae, Papaveraceae, Poaceae, Polygonaceae, Punicaceae, Rosaceae, Rubiaceae, Rutaceae, Scrophulariaceae, Solanaceae, Sterculiaceae and Valerianaceae.

Examples which may be mentioned are the following plants: Anacardiaceae such as the genera *Pistacia, Mangifera, Anacardium*, for example the genus and species *Pistacia vera* [pistachio], *Mangifer indica* (mango) or *Anacardium occidentale* (cashew), Asteraceae such as the genera *Calendula, Carthamus, Centaurea, Cichorium, Cynara, Helianthus, Lactuca, Locusta, Tagetes, Valeriana*, e.g. the genus and species *Calendula officinalis* (common marigold), *Carthamus tinctorius* (safflower), *Centaurea cyanus* (cornflower), *Cichorium intybus* (chicory), *Cynara scolymus* (artichoke), *Helianthus annus* (sunflower), *Lactuca sativa, Lactuca crispa, Lactuca esculenta, Lactuca scariola* L. ssp. *sativa, Lactus scariola* L. var. *integrata, Lactuca scariola* L. var. *integrifolia, Lactuca sativa* subsp. *romana, Locusta communis, Valeriana locusta* (lettuce), *Tagetes lucida, Tagetes erecta* or *Tagetes tenuifolia* (French marigold), Apiaceae such as the genus *Daucus*, e.g. the genus and species *Daucus carota* (carrot), Betulaceae such as the genus *Corylus*, e.g. the genera and species *Corylus avellana* or *Corylus colurna* (hazelnut), Boraginaceae such as the genus *Borago*, e.g. the genus and species *Borago officinalis* (borage), Brassicaceae such as the genera *Brassica, Camelina, Melanosinapis, Sinapis, Arabadopsis*, e.g. the genera and species *Brassica napus, Brassica rapa* ssp. (oilseed rape), *Sinapis arvensis Brassica juncea, Brassica juncea* var. *juncea, Brassica juncea* var. *crispifolia, Brassica juncea* var. *foliosa, Brassica nigra, Brassica sinapioides, Camelina sativa, Melanosinapis communis* (mustard), *Brassica oleracea* (feed beet) or *Arabidopsis thaliana*, Bromeliaceae such as the genera *Anana, Bromelia* (pineapple), e.g. the genera and species *Anana comosus, Ananas ananas* or *Bromelia comosa* (pineapple), Caricaceae such as the genus *Carica* such as the genus and species *Carica papaya* (papaya), Cannabaceae such as the genus *Cannabis* such as the genus and species *Cannabis sative* (hemp), Convolvulaceae such as the genera *Ipomoea, Convolvulus*, e.g. the genera and species *Ipomoea batatus, Ipomoea pandurata, Convolvulus batatas, Convolvulus tiliaceus, Ipomoea fastigiata, Ipomoea tiliacea, Ipomoea triloba* or *Convolvulus panduratus* (sweet potato, batate), Chenopodiaceae such as the genus Beta such as the genera and species *Beta vulgaris, Beta vulgaris* var. *altissima, Beta vulgaris* var. *vulgaris, Beta maritima, Beta vulgaris* var. *perennis, Beta vulgaris* var. *conditiva* or *Beta vulgaris* var. *esculenta* (sugarbeet), Cucurbitaceae such as the genus *Cucubita*, e.g. the genera and species *Cucurbita maxima, Cucurbita mixta, Cucurbita pepo* or *Cucurbita moschata* (pumpkin), Elaeagnaceae such as the genus *Elaeagnus*, e.g. the genus and species *Olea europaea* (olive), Ericaceae such as the genus *Kalmia*, e.g. the genera and species *Kalmia latifolia, Kalmia angustifolia, Kalmia microphylla, Kalmia polifolia, Kalmia occidentalis, Cistus chamaerhodendros* or *Kalmia lucida* (mountain laurel), Euphorbiaceae such as the genera *Manihot, Janipha, Jatropha, Ricinus*, e.g. the genera and species *Manihot utilissima, Janipha manihot, Jatropha manihot, Manihot aipil, Manihot dulcis, Manihot manihot, Manihot melanobasis, Manihot esculenta* (cassava) or *Ricinis communis* (castor oil plant), Fabaceae such as the genera *Pisum, Albizia, Cathormion, Feuillea, Inga, Pithecolobium, Acacia, Mimosa, Medicajo, Glycine, Dolichos, Phaseolus, Soja*, e.g. the genera and species *Pisum sativum, Pisum arvense, Pisum humile* (pea), *Albizia berteriana, Albizia julibrissin, Albizia lebbeck, Acacia berteriana, Acacia littoralis, Albizia berteriana, Albizia berteriana, Cathormion berteriana, Feuillea berteriana, Inga fragrans, Pithecellobium berterianum, Pithecellobium fragrans, Pithecolobium berterianum, Pseudalbizzia berteriana, Acacia julibrissin, Acacia nemu, Albizia nemu, Feuilleea julibrissin, Mimosa julibrissin, Mimosa speciosa, Sericanrda julibrissin, Acacia lebbeck, Acacia macrophylla, Albizia lebbek, Feuilleea lebbeck, Mimosa lebbeck, Mimosa speciosa* (acacia), *Medicago sativa, Medicago falcata, Medicago varia* (alfalfa) *Glycine max Dolichos soja, Glycine gracilis, Glycine hispida, Phaseolus max, Soja hispida* or *Soja max* (soybean), Geraniaceae such as the genera *Pelargonium, Cocos, Oleum*, e.g. the genera and species *Cocos nucifera, Pelargonium grossularioides* or *Oleum cocois* (coconut), Gramineae such as the genus *Saccharum*, e.g. the genus and species *Saccharum officinarum*, Juglandaceae such as the genera *Juglans, Wallia*, e.g. the genera and species *Juglans regia, Juglans ailanthifolia, Juglans sieboldiana, Juglans cinerea, Wallia cinerea, Juglans bixbyi, Juglans californica, Juglans hindsii, Juglans intermedia, Juglans jamaicensis, Juglans major, Juglans microcarpa, Juglans nigra* or *Wallia nigra* (walnut), Lauraceae such as the genera *Persea, Laurus*, e.g. the genera and species *Laurus nobilis* (bay), *Persea americana, Persea gratissima* or *Persea persea* (avocado), Leguminosae such as the genus *Arachis*. e.g. the genus and species *Arachis hypogaea* (peanut), Linaceae such as the genera *Linum, Adenolinum*, e.g. the genera and species *Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne* var. *lewisii, Linum pratense* or *Linum trigynum* (flax), Lythrarieae such as the genus *Punica*, e.g. the genus and species *Punica granatum* (pomegranate), Malvaceae such as the genus *Gossypium*, e.g. the genera and species *Gossypium hirsutum, Gossypium arboreum, Gossypium barbadense, Gossypium herbaceum* or *Gossypium thurberi* (cotton), Musaceae such as the genus *Musa*, e.g. the genera and species *Musa nana, Musa acuminata, Musa paradisiaca, Musa* spp. (banana), Onagraceae such as the genera *Camissonia, Oenothera*, e.g. the genera and species *Oenothera biennis* or *Camissonia brevipes* (evening primrose), Palmae such as the genus *Elaeis*, e.g. the genus and species *Elaeis guineensis* (oil palm), Papaveraceae such as the genus *Papaver*, e.g. the genera and species *Papaver orientale, Papaver rhoeas, Papaver dubium* (poppy), Pedaliaceae such as the genus *Sesamum* e.g the genus and species *Sesamum indicum* (sesame), Piperaceae such as the genera *Piper, Artanthe, Peperomia, Steffensia*, e.g. the genera and species *Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata* (cayenne pepper), Poaceae such as the genera *Hordeum, Secale, Avena, Sorghum, Andropogon, Holcus, Panicum, Oryza, Zea* (corn), *triticum*, e.g. the genera and species *Hordeum vulgare, Hordeum jubatum, Hordeum murinum, Hordeum secalinum, Hordeum distichon, Hordeum aegiceras, Hordeum hexastichon, Hordeum hexastichum, Hordeum irregulare, Hordeum sativum, Hordeum secalinum* (barley), *Secale cereale* (rye), *Avena sativa, Avena fatua, Avena byzantina, Avena fatua* var. *sativa, Avena hybrida* (oats), *Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna,*

*Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum, Panicum militaceum* (millet), *Oryza sativa, Oryza latifolia* (rice), *Zea mays* (corn), *Triticum aestivum, Triticum durum, Triticum turgidum, Triticum hybernum, Triticum macha, Triticum sativum* or *Triticum vulgare* (wheat), Porphyridiaceae such as the genera *Chroothece, Flintiella, Petrovanella, Porphyridium, Rhodella, Rhodosorus, Vanhoeffenia*, e.g. the genus and species *Porphyridium cruentum*, Proteaceae such as the genus *Macadamia*, e.g. the genus and species *Macadamia intergrifolia* (macadamia), Rubiaceae such as the genus *Coffea*, e.g. the genera and species *Coffea* spp., *Coffea arabica, Coffea canephora* or *Coffea liberica* (coffee), Scrophulariaceae such as the genus *Verbascum*, e.g. the genera and species *Verbascum blattaria, Verbascum chaixii, Verbascum densiflorum, Verbascum lagurus, Verbascum longifolium, Verbascum lychnitis, Verbascum nigrum, Verbascum olympicum, Verbascum phlomoides, Verbascum phoenicum, Verbascum pulverulentum* or *Verbascum thapsus* (mullein), Solanaceae such as the genera *Capsicum, Nicotiana, Solanum, Lycopersicon*, e.g. the genera and species *Capsicum annuum, Capsicum annuum* var. *glabriusculum, Capsicum frutescens* (pepper), *Capsicum annuum* (paprika), *Nicotiana tabacum, Nicotiana alata, Nicotiana attenuata, Nicotiana glauca, Nicotiana langsdorffii, Nicotiana obtusifolia, Nicotiana quadrivalvis, Nicotiana repanda, Nicotiana rustica, Nicotiana sylvestris* (tobacco), *Solanum tuberosum* (potato), *Solanum melongena* (aubergine), *Lycopersicon esculentum, Lycopersicon lycopersicum, Lycopersicon pyriforme, Solanum integrifolium* or *Solanum lycopersicum* (tomato), Sterculiaceae such as the genus *Theobroma*, e.g. the genus and species *Theobroma cacao* (cocoa), or Theaceae such as the genus *Camellia*, e.g. the genus and species *Camellia sinensis* (tea).

In an advantageous embodiment of the process, the useful plants used are oil fruit plants which comprise large amounts of lipid compounds, such as peanut, oilseed rape, canola, sunflower, safflower (*Carthamus tinctoria*), poppy, mustard, hemp, castor-oil plant, olive, sesame, *Calendula, Punica*, evening primrose, *verbascum,* thistle, wild roses, hazelnut, almond, *macadamia,* avocado, bay, pumpkin/squash, flax, soybean, pistachios, borage, trees (oil palm, coconut or walnut) or arable crops such as maize, wheat, rye, oats, triticale, rice, barley, cotton, cassava, pepper, *Tagetes,* Solanaceae plants such as potato, tobacco, egg plant and tomato, *Vicia* species, pea, alfalfa or bushy plants (coffee, cacao, tea), *Salix* species, and perennial grasses and fodder crops. Advantageous plants according to the invention are oil fruit plants such as peanut, oilseed rape, canola, sunflower, safflower, poppy, mustard, hemp, castor-oil plant, olive, *Calendula, Punica*, evening primrose, pumpkin/squash, flax, soybean, borage, trees (oilpalm, coconut). Especially preferred are plants which are high in C18:2- and/or C18:3-fatty acids, such as sunflower, safflower, tobacco, *verbascum,* sesame, cotton, pumpkin/squash, poppy, evening primrose, walnut, flax, hemp or thistle. Very especially preferred plants are plants such as safflower, sunflower, poppy, evening primrose, walnut, flax, or hemp.

It is also advantageous to express the nucleic acid sequences of the invention in the leaves of feed or food plants and thus to increase the content of eicosapentaenoic acid, docosapentaenoic acid and/or docosahexaenoic acid in the leaves. Preferred feed plants are, for example, trefoil species such as red clover (*Trifolium pratense*), white clover (*Trifolium repens*), alsike clover (*Trifolium hybridum*), sainfoin (*Onobrychis viccifolia*), Egyptian clover (*Trifolium alexandrinium*) and Persian clover (*Trifolium resupinatum*). Preferred food plants are for instance lettuce species such as *Lactuca sativa, Lactuca crispa, Lactuca esculenta, Lactuca scariola* L. ssp. *sativa, Lactuca scariola* L. var. *integrata, Lactuca scariola* L. var. *integrifolia, Lactuca sativa* subsp. *romana, Locusta communis* and *Valeriana locusta.*

It is possible through the enzymatic activity of the nucleic acid sequences which are used in the process of the invention and which code for polypeptides having Δ-6-elongase, Δ-6-desaturase, Δ-5-desaturase and/or Δ-5-elongase activity, advantageously in combination with nucleic acid sequences which code for polypeptides having ω-3-desaturase and/or Δ-4-desaturase activity, and further nucleic acid sequences which code for polypeptides of fatty acid or lipid metabolism, such as further polypeptides having Δ-5-, Δ-6-, Δ-8-, Δ-12-desaturase or Δ-5-, Δ-6- or Δ-9-elongase activity, to produce a wide variety of polyunsaturated fatty acids in the process of the invention. Depending on the useful plants chosen for use in the process of the invention, mixtures of the various polyunsaturated fatty acids or individual polyunsaturated fatty acids such as EPA, DPA or DHA can be produced in free or bound form. Depending on the prevailing fatty acid composition in the starting plant (C18:2 or C18:3 fatty acids), the resulting fatty acids are derived from C18:2 fatty acids, such as GLA, DGLA or ARA or are derived from C18:3 fatty acids, such as EPA, DPA or DHA. If the only unsaturated fatty acid present in the plant used for the process is linoleic acid (LA, C18:2$^{\Delta 9,12}$), the only possible products of the process are GLA, DGLA and ARA, which may be present as free fatty acids or bound. If the only unsaturated fatty acid present in the plant used in the process is α-linolenic acid (ALA, C18:3$^{\Delta 9,12,15}$), for example as in flax, the only possible products of the process are SDA, ETA, EPA, DPA and/or DHA, which may be present as described above as free fatty acids or bound. It is possible to produce in a targeted manner only individual products in the plant by modifying the activity of the enzymes used in the process and involved in the synthesis Δ-6-elongase, Δ-6-desaturase, Δ-5-desaturase and/or Δ-6-elongase, advantageously in combination with further genes of lipid or fatty acid metabolism. Advantageously, only EPA, DPA or DHA or mixtures thereof are synthesized. Since the fatty acids are synthesized in biosynthesis chains, the respective final products are not present as pure substances in the organisms. Small amounts of the precursor compounds are always also present in the final product. These small amounts are less than 20% by weight, advantageously less than 15% by weight, particularly advantageously less than 10% by weight, very particularly advantageously less than 5, 4, 3, 2 or 1% by weight based on the final products EPA, DPA or DHA or mixtures thereof.

To increase the yield in the process according to the invention for the production of oils and/or triglycerides with a polyunsaturated fatty acid, content which is advantageously increased, it is advantageous to increase the amount of starting product for the synthesis of fatty acids. This can be achieved for example by introducing a nucleic acid which encodes a polypeptide with 412-desaturase into the organism. This is particularly advantageous in useful plants, such as oil-producing plants such as plants of the Brassicaceae family, such as the genus *Brassica*, for example rape; the Elaeagnaceae family, such as the genus *Elaeagnus*, for example the genus and species *Olea europaea* or the family Fabaceae, such as the genus *Glycine*, for example the genus and species *Glycine max*, which are high in oleic acid. Since these organisms have an only low linoleic acid content (Mikoklajczak et al. (1961) Journal of the American Oil Chemical Society 38: 678-681) it is advantageous to use said Δ12-desaturases for producing the starting material linolenic acid from oleic acid. It is also possible in addition for the starting fatty acids to be provided from outside, but this is less preferred for reasons of cost.

Mosses and algae are the only plant systems known to produce considerable amounts of polyunsaturated fatty acids such as arachidonic acid (ARA) and/or eicosapentaenoic acid (EPA) and/or docosahexaenoic acid (DHA). Mosses comprise PUFAs in membrane lipids, whereas algae, organisms related to algae, and some fungi also accumulate substantial amounts of PUFAs in the triacylglycerol fraction. Nucleic acid molecules isolated from strains which accumulate PUFAs also in the triacylglycerol fraction are therefore particularly advantageous for the process of the invention and thus for modifying the lipid and PUFA production system in a plant such as a useful plant such as an oil crop plant, for example oilseed rape, canola, flax, hemp, soybean, sunflower, borage. They can therefore advantageously be used in the process of the invention.

Nucleic acids used in the process of the invention are advantageously derived from plants such as algae, for example algae of the family of Prasinophyceae such as from the genera *Heteromastix, Mammella, Mantoniella, Micromonas, Nephroselmis, Ostreococcus, Prasinocladus, Prasinococcus, Pseudoscourfielda, Pycnoocus, Pyramimonas, Scherffelia* or *Tetraselmis* such as the genera and species *Heteromastix longifillis, Mamiella gilva, Mantoiella squamata, Micromonas pusilla, Nephroselmis olivacea, Nephroselmis pyriformis, Neproselmis rotunda, Ostreococcus tauri, Ostreococcus sp. Prasinocladus ascus, Prasinocladus lubricus, Pycnococcus provasolii, Pyramimonas amylifera, Pyramimonas disomata, Pyramimonas obovata, Pyramimonas orientalis, Pyramimonas parkae, Pyramimonas spinefera, Pyramimonas sp., Tetraselmis apiculta, Tetraselmis carteriaformis, Tetraselmis chui, Tetraselmis convolutae, Tetraselrnis desikacharyl, Tetraselmis gracilis, Tetraselmis hazeni, Tetraselmis impellucida, Tetraselmis inconspicua, Tetraselmis levis, Tetraselmis maculata, Tetraselmis marina, Tetraselmis striata, Tetraselmis subcordiformis, Tetraselmis suecica, Tetraselmis tetrabrachia, Tetraselmis tetrathele, Tetraselmis verrucosa, Tetraselmis verrucosa fo. rubens* or *Tetraselmis sp.* or algae from the family Euglenaceae such as from the genera *Ascoglena, Astasia, Colacium, Cyclidiopsis, Euglena, Euglenopsis, Hyalophacus, Khawkinea, Lepocinclis, Phacus, Strombomonas* or *Trachelomonas* such as the genera and species *Euglena acus, Euglena geniculata, Euglena gracilis, Euglena mixocylindracea, Euglena rostrifera, Euglena viridis, Colacium stentorium, Trachelomonas cylindrica* or *Trachelomonas volvocina.*

Further advantageous plants are algae such as *Isochrysis* or *Crypthecodinium*, algae/diatoms such as *Thalassiosira* or *Phaeodactylum*, mosses such as *Physcomitrella* or *Ceratodon* or higher plants such as the Primulaceae such as *Aleuritia, Calendula stella, Osteospermum spinescens* or *Osteospermum hyoseroides*, microorganisms such as fungi such as *Aspergillus, Thraustochytrium, Phytophthora, Entomophthora, Mucor* or *Mortierella*, bacteria such as shewanella, yeasts or animals such as nematodes such as *Caenorhabditis*, insects, frogs, sea cucumbers or fishes. The nucleic acid sequences isolated according to the invention are advantageously derived from an animal from the order of vertebrates. The nucleic acid sequences are preferably derived from the class of *Vertebrata; Euteleostomi, Actinopterygii; Neopterygii; Teleostei; Euteleostei, Protacanthopterygii, Salmoniformes; Salmonidae* or *Oncorhynchus* or *Vertebrata, Amphibia, Anura, Pipidae, Xenopus* or *Evertebrata* such as *Protochordata, Tunicata, Holothuroidea, Cionidae* such as *Amaroucium constellatum, Botryllus schlosseri, Ciona intestinalis, Molgula citrina, Molgula manhattensis, Perophora viridis* or *Styela partita*. The nucleic acids are particularly advantageously derived from fungi, animals or from plants such as algae or mosses, preferably from the order of Salmoniformes such as of the family of Salmonidae such as of the genus *Salmo*, for example from the genera and species *Oncorhynchus mykiss, Trutta trutta* or *Salmo trutta fario*, from algae such as the genera *Mantoniella* or *Ostreococcus* or from the diatoms such as the genera *Thalassiosira* or *Phaeodactylum* or from algae such as *Crypthecodinium*.

In a preferred embodiment, the process further comprises the step of obtaining a cell or a whole plant which comprises the nucleic acid sequences which are used in the process and which code for a Δ-6-desaturase, Δ-6-elongase, Δ-5-desaturase and/or Δ-5-elongase and, if appropriate, nucleic acid sequences which code for an ω-3-desaturase and/or a Δ-4-desaturase, it being possible for the cell and/or the useful plant also to comprise further nucleic acid sequences of lipid or fatty acid metabolism. The nucleic acid sequences preferably used in the process are for expression advantageously incorporated into at least one gene construct and/or a vector as described hereinafter, alone or in combination with further nucleic acid sequences which code for proteins of fatty acid or lipid metabolism, and finally transformed into the cell or plant. In a further preferred embodiment, this process further comprises the step of obtaining the oils, lipids or free fatty acids from the useful plants, The cell produced in this way or the useful plant produced in this way is advantageously a cell of an oil-producing plant, vegetable plant, lettuce plant, or ornamental plant or the plant itself as stated above.

Growing means for the cultivation in the case of plant cells, tissue or organs on or in a nutrient medium or of the whole plant on or in a substrate, for example in hydroculture, flower pot soil or on an arable field.

For the purposes of the invention, "transgenic" or "recombinant" means with regard to, for example, a nucleic acid sequence, an expression cassette (=gene construct) or a vector comprising the nucleic acid sequences used in the process according to the invention or a plant transformed with the nucleic acid sequences, expression cassette or vector used in the process according to the invention, all those constructions brought about by recombinant methods in which either a) the nucleic acid sequence, or
b) a genetic control sequence which is operably linked with the nucleic acid sequence, for example a promoter, or
c) (a) and (b)

are not located in their natural genetic environment or have been modified by recombinant methods, it being possible for the modification to be, for example, a substitution, addition, deletion, inversion or insertion of one or more nucleotide residues. Natural genetic environment means the natural genomic or chromosomal locus in the original organism or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, very especially preferably at least 5000 bp. A naturally occurring expression cassette—for example the naturally occurring combination of the natural promoter of the nucleic acid sequence used in the process according to the invention with the nucleic acid sequence which encodes proteins with corresponding Δ6-desaturase, Δ6-elongase, Δ5-desaturase and Δ5-elongase activity, advantageously in combination with nucleic acid sequences which encode proteins having ω3-desaturase and/or Δ4-desaturase activity—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

A "transgenic plant" for the purposes of the invention is understood as mentioned above as meaning that the nucleic acids used in the process are not at their natural locus in the genome of the plant. In this case, it is possible for the nucleic acid sequences to be expressed homologously or heterologously. However, transgenic also means that, while the nucleic acids according to the invention are at their natural position in the genome of the plant, the sequence has been modified with regard to the natural sequence, and/or that the regulatory sequences of the natural sequences have been modified. Transgenic is preferably understood as meaning the expression of the nucleic acids used in the process according to the invention at an unnatural locus in the genome, i.e. homologous or, preferably, heterologous expression of the nucleic acid sequences takes place.

Preferred transgenic organisms are useful plants such as oil-producing plants, vegetable plants, lettuce plants or ornamental plants which are advantageously selected from the group of plant families consisting of the families of Aceraceae, Actinidiaceae, Anacardiaceae, Apiaceae, Areoaceae, Asteraceae, Arecaceae, Betulaceae, Boraginaceae, Brassicaceae, Bromeliaceae, Cannabaceae, Cannaceae, Caprifoliaceae, Chenopodiaceae, Convolvulaceae, Cucurbitaceae, Dioscoreaceae, Elaeagnaceae, Ericaceae, Euphorbiaceae, Fabaceae, Fagaceae, Grossulariaceae, Juglandaceae, Lauraceae, Liliaceae, Linaceae, Malvaceae, Moraceae, Musaceae, Oleaceae, Oxalidaceae, Papaveraceae, Poaceae, Polygonaceae, Punicaceae, Rosaceae, Rubiaceae, Rutaceae, Scrophulariaceae, Solanaceae, Sterculiaceae and Valerianaceae.

Host plants which are suitable for the nucleic acids, the expression cassette or the vector used in the process according to the invention are, in principle, advantageously all useful plants which are capable of synthesizing fatty acids, specifically unsaturated fatty acids, and which are suitable for the expression of recombinant genes. Examples which should be mentioned at this point are plants such as *Arabidopsis*, Asteraceae such as *Calendula* or useful plants such as soybean, peanut, castor-oil plant, sunflower, maize, cotton, flax, oilseed rape, coconut, oil palm, safflower (*Carthamus tinctorius*) or cacao bean. Further advantageous plants are mentioned at other points in this application.

Microorganisms are generally used as intermediate hosts for the production of transgenic useful plants. Such utilizable intermediate host cells are detailed in: Goeddel, Gene Expression Technology Methods in Enzymology 185, Academic Press, San Diego, Calif. (1990).

Expression strains which can advantageously be used for this purpose are, for example, those with a lower protease activity. They are described, for example, in: Gottesman, S., Gene Expression Technology Methods in Enzymology 185, Academic Press, San Diego, Calif. (1990) 119-128.

Transgenic plants which comprise the polyunsaturated, long-chain fatty acids synthesized in the process according to the invention can advantageously be marketed directly without there being any need for the oils, lipids or fatty acids synthesized to be isolated. This form of marketing is particularly advantageous.

"Plants" for the purposes of the present invention are intact plants and all plant parts, plant organs or plant parts such as leaf, stem, seeds, root, tubers, anthers, fibers, root hairs, stalks, embryos, calli, cotelydons, petioles, harvested material, plant tissue, reproductive tissue and cell cultures which are derived from the actual transgenic plant and/or can be used for bringing about the transgenic plant. In this context, the seed comprises all parts of the seed such as the seed coats, epidermal cells, seed cells, endosperm or embryonic tissue.

The compounds produced in the process of the invention can, however, also be isolated from the plants in the form of their oils, fat, lipids and/or free fatty acids. Polyunsaturated fatty acids produced by the process of the invention can be obtained by harvesting the plants or plant cells either from the culture in which they grow or from the field. This can take place by pressing or extracting the plant parts, preferably the plant seeds. It is possible in this connection for the oils, fats, lipids and/or free fatty acids to be obtained by pressing by so-called cold drawing or cold pressing without input of heat. To make it easier to break open the plant parts, specifically the seeds, they are previously crushed, steamed or roasted. The seeds pretreated in this way can then be pressed or extracted with solvent such as warm hexane. The solvent is then removed again. It is possible in this way to isolate more than 96% of the compounds produced in the process of the invention. The products obtained in this way are then processed further, that is to say refined. This entails initially for example the plant mucilage and suspended matter being removed. So-called desliming can take place enzymatically or, for example, chemically/physically by adding acid such as phosphoric acid. The free fatty acids are then removed by treatment with a base, for example sodium hydroxide solution. The resulting product is thoroughly washed with water to remove the alkali remaining in the product, and is dried. In order to remove the coloring matters still present in the product, the products are subjected to a bleaching with, for example, bleaching earth or activated carbon. Finally, the product is also deodorized for example with steam.

The PUFAs or LCPUFAs produced by this process are preferably $C_{20}$ and/or $C_{22}$ fatty acid molecules having at least four double bonds in the fatty acid molecule, preferably five or six double bonds. These $C_{20}$ and/or $C_{22}$ fatty acid molecules can be isolated from the plant in the form of an oil, lipid or a free fatty acid. Suitable transgenic plants are for example those mentioned above.

These oils, lipids or fatty acids of the invention comprise, as described above, advantageously 6 to 15% palmitic acid, 1 to 6% stearic acid; 7-85% oleic acid; 0.5 to 8% vaccenic acid, 0.1 to 1% arachic acid, 7 to 25% saturated fatty acids, 8 to 85% monounsaturated fatty acids and 60 to 85% polyunsaturated fatty acids, in each case based on 100% and on the total fatty acid content of the plants.

Advantageous polyunsaturated, long-chain fatty acids present in the fatty acid esters or fatty acid mixtures such as phosphatidyl fatty acid esters or triacylglyceride esters are preferably at least 10; 11; 12; 13; 14; 15; 16; 17; 18; 19 or 20% by weight based on the total fatty acid content of eicosapentaenoic acid, based on the total fatty acid content, and/or at least 1; 2; 3; 4; 5 or 6% by weight of docosapentaenoic acid, based on the total fatty acid content, and/or at least 1; 2; 3; preferably at least 4; 5; 6; particularly preferably at least 7 or 8 and most preferably at least 9 or 10% by weight of docosahexaenoic acid, based on the total fatty acid content.

The fatty acid esters or fatty acid mixtures which have been produced by the process of the invention further comprise fatty acids selected from the group of fatty acids erucic acid (13-docosaic acid), sterculic acid (9,10-methylene octadec-9-enonic acid), malvalic acid (8,9-methylene heptadec-8-enonic acid), chaulmoogrinic acid (cyclopentenedodecanoic acid), furan fatty acid (9,12-epoxyoctadeca-9,11-dienonoic acid), vemonoic acid (9,10-epoxyoctadec-12-erionoic acid), tarinic acid (6-octadecynonic acid), 6-nonadecynonic acid, santalbic acid (t11-octadecen-9-ynoic acid), 6,9-octadecenynonic acid, pyrulic acid (t10-heptadecen-8-ynonic acid), crepenynic acid (9-octadecen-12-ynonic acid) 13,14-dihydroorpheic acid, octadecen-13-ene-9,11-diynonic acid, petroselenic acid (cis-6-octadecenonic acid), 9c,12t-octadecadienoic acid, calendulic acid (8t10t12c-octadecatrienoic acid, catalpic acid (9t11t13c-octadecatrienoic acid), eleosteric acid (9c11t13t-octadecatrienoic acid), jacaric acid (8c10t12c-octadecatrienoic acid), punicic acid (9c11t13c-octadecatrienoic acid), parinaric acid (9c11t13t15c-octadecatetraenoic acid), pinolenic acid (all-cis-5,9,12-octadecatrienoic acid), laballenic acid (5,6-octadecadienallenic acid), ricinoleic acid (12-hydroxyoleic acid) and/or coriolic acid (13-hydroxy-9c,11t-octadecadienonic acid). In general, the aforementioned fatty acids are advantageously present only in traces in the fatty acid esters or fatty acid mixtures produced by the process of the invention, meaning that their occurrence, based on the total fatty acid content, is less than 30%, preferably less than 25%, 24%, 23%, 22% or 21%, particularly preferably less than 20%, 15%, 10%, 9%, 8%, 7%, 6% or 5%, very particularly preferably less than 4%, 3%, 2% or 1%. In a further preferred form of the invention the occurrence of these aforementioned fatty acids, based on the total fatty acids, is less than 0.9%; 0.8%; 0.7%; 0.6% or 0.5%, particularly preferably less than 0.4%; 0.3%; 0.2%; 0.1%. The fatty acid esters or fatty acid mixtures produced by the process of the invention advantageously comprise less than 0.1% based on the total fatty acids and/or no butyric acid, no cholesterol and no nisinic acid (tetracosahexaenoic acid, $C23:6^{\Delta3,8,12,15,18,21}$).

A further embodiment according to the invention is the use of the oils, the lipids, the fatty acids and/or the fatty acid composition, which are produced by the process of the invention, in feeding stuffs, foodstuffs, cosmetics or pharmaceuticals. The oils, lipids, fatty acids or fatty acid mixtures obtained in the process according to the invention can be used for admixture with other oils, lipids, fatty acids or fatty acid mixtures of animal origin, such as, for example, fish oils, in the manner with which the skilled worker is familiar. These oils, lipids, fatty acids or fatty acid mixtures which are produced in this way and consist of vegetable and animal components can also be used for the preparation of feeding stuffs, foodstuffs, cosmetics or pharmaceuticals.

The term "oil", "lipid" or "fat" is understood as meaning a fatty acid mixture comprising unsaturated and/or saturated, preferably esterified fatty acid(s). It is preferred that the oil, fat or lipid is high in polyunsaturated free or advantageously esterified fatty acid(s), in particular linoleic acid, γ-linolenic acid, dihomo-γ-linolenic acid, arachidonic acid, α-linolenic acid, stearidonic acid, eicosatetraenoic acid, eicosapentaenoic acid, docosapentaenoic acid or docosahexaenoic acid. Preferably, the amount of unsaturated esterified fatty acids is approximately 30%, with an amount of 50% being especially preferred and an amount of 60%, 70%, 80% or more being most preferred. The amount of the fatty acid can be determined by gas chromatography after converting the fatty acids into the methyl esters by transesterification. The oil, lipid or fat can comprise various other saturated or unsaturated fatty acids, for example calendulic acid, palmitic acid, palmitoleic acid, stearic acid, oleic acid and the like. In particular, the amount of the various fatty acids can vary, depending on the starting plant.

As described above, the polyunsaturated fatty acid esters advantageously having three, four, five or six, particularly advantageously having five or six double bonds and which have been prepared in the process advantageously take the four of fatty acid esters, for example, sphingolipid esters, phosphoglyceride esters, lipid esters, glycolipid esters, phospholipid esters, monoacylglycerol esters, diacylglycerol esters, triacylglycerol esters or other fatty acid esters, preference being given to phospholipid esters and/or triacylglycerol esters.

Starting with the polyunsaturated fatty acid esters produced thus in the process according to the invention and advantageously having at least three, four, five or six double bonds, the polyunsaturated fatty acids which are present can be liberated for example via treatment with alkali, for example with aqueous KOH or NaOH, or by acid hydrolysis, advantageously in the presence of an alcohol such as methanol or ethanol, or via enzymatic cleavage, and isolated via, for example, phase separation and subsequent acidification with, for example, $H_2SO_4$. However, the fatty acids can also be liberated directly without the above-described processing steps.

Substrates of the nucleic acid sequences used in the process which encode polypeptides with Δ6-desaturase, Δ6-elongase, Δ5-desaturase and/or Δ5-elongase activity and optionally nucleic acid sequences which encode polypeptides having Ω3-desaturase and/or Δ4-desaturase activity, and/or of the further nucleic acids which are used, such as the nucleic acid sequences which encode polypeptides of the fatty acid or lipid metabolism selected from the group consisting of acyl-CoA dehydrogenase(s), acyl-ACP [=acyl carrier protein] desaturase(s), acyl-ACP thioesterase(s), fatty acid acyl transferase(s), acyl-CoA:lysophospholipid acyltransferases, fatty acid synthase(s), fatty acid hydroxylase(s), acetyl-coenzyme A carboxylase(s), acyl-coenzyme A oxidase(s), fatty acid desaturase(s), fatty acid acetylenases, lipoxygenases, triacylglycerol lipases, allenoxide synthases, hydroperoxide lyases or fatty acid elongase(s) are advantageously $C_{16}$-, $C_{18}$- or $C_{20}$-fatty acids. Preferably, the fatty acids converted in the process as substrates are converted in the form of their acyl-CoA esters and/or in the form of their phospholipid esters.

To produce the long-chain PUFAs according to the invention, the saturated, monounsaturated $C_{16}$-fatty acids and/or polyunsaturated $C_{18}$-fatty acids must first, depending on the substrate, be desaturated and/or elongated or only desaturated by the enzymatic activity of a desaturase and/or elongase and subsequently elongated by at least two carbon atoms by an elongase. After one elongation cycle, this enzyme activity leads either starting from $C_{16}$-fatty acids to $C_{18}$-fatty acids or starting from $C_{18}$-fatty acids to $C_{20}$-fatty acids, and after two elongation cycles starting from $C_{16}$-fatty acids leads to $C_{20}$-fatty acids. The activity of the desaturases or elongases used in the process according to the invention preferably leads to $C_{20}$- and/or $C_{22}$-fatty acids, advantageously with at least two or three double bonds in the fatty acid molecule, preferably with four, five or six double bonds, especially preferably to $C_{22}$-fatty acids with at least five double bonds in the fatty acid molecule. Especially preferred products of the process according to the invention are eicosapentaenoic acid, docosapentaenoic acid and/or docosahexaenoic acid. The $C_{18}$-fatty acids with at least two double bonds in the fatty acid can be elongated by the enzymatic activity according to the invention in the form of the free fatty acid or in the form of the esters, such as phospholipids, glycolipids, sphingolipids, phosphoglycerides, monoacylglycerol, diacylglycerol or triacylglycerol.

The preferred biosynthesis site of fatty acids, oils, lipids or fats in the plants which are advantageously used is, for example, generally the seed or cell layers of the seed, so that seed-specific expression of the nucleic acids used in the process makes sense. However, it is obvious that the biosynthesis of fatty acids, oils or lipids need not be limited to the seed tissue, but may also take place in a tissue specific manner in all of the remaining parts of the plant, for example in epidermal cells or in the tubers. The synthesis advantageously takes place according to the inventive process in the vegetative (somatic) tissue.

Owing to the method according to the invention, the polyunsaturated fatty acids which are produced can, in principle, be increased in two ways in the plants used in the process. Advantageously the pool of free polyunsaturated fatty acids and/or the amount of the esterified polyunsaturated fatty acids produced by the process can be increased. Advantageously, the pool of esterified polyunsaturated fatty acids in the transgenic plants is increased by the process according to the invention, advantageously in the form of the phosphatidyl esters and/or triacyl esters.

The sequences used in the process of the invention are cloned singly into expression constructs or provided on a joint recombinant nucleic acid molecule and used for introduction and for expression in organisms. These expression constructs make it possible for the polyunsaturated fatty acids produced in the process of the invention to be synthesized optimally.

The nucleic acids used in the process may, after introduction into a plant or plant cell, either be located on a separate plasmid or advantageously be integrated into the genome of the host cell. In the case of integration into the genome, the integration may be random or take place by recombination such that the native gene is replaced by the introduced copy, thus modulating production of the desired compound by the cell, or through use of a gene in trans, so that the gene is functionally connected to a functional expression unit which comprises at least one sequence ensuring the expression of a gene and at least one sequence ensuring the polyadenylation of a functionally transcribed gene. The nucleic acid sequences are advantageously introduced into the plants via multiexpression cassettes or constructs for multiparallel expression, i.e. the nucleic acid sequences are present in a joint expression unit.

The nucleic acid construct may comprise more than one nucleic acid sequence coding for a polypeptide having the enzymatic activity of a Δ-12-desaturase, Δ-4-desaturase, Δ-5-desaturase, Δ-6-desaturase, Δ-5-elongase, Δ-6-elongase, and/or ω-3-desaturase. It is also possible for a plurality of copies of a nucleic acid sequence coding for a polypeptide having the enzymatic activity of a Δ-12-desaturase, Δ-4-desaturase, Δ-5-desaturase, Δ-6-desaturase, Δ-5-elongase, Δ-6-elongase, and/or ω-3-desaturase to be present.

For the introduction, the nucleic acids used in the process are advantageously amplified and ligated in the known manner. Preferably, a procedure following the protocol for Pfu DNA polymerase or a Pfu/Taq DNA polymerase mixture is followed. The primers are selected depending on the sequence to be amplified. The primers should expediently be chosen in such a way that the amplicon comprises the entire codogenic sequence from the start codon to the stop codon. After the amplification, the amplificon is expediently analyzed. For example, the analysis can be carried out by gel-electrophoretic separation with respect to quality and quantity. Thereafter, the amplicon can be purified following a standard protocol (for example Qiagen). An aliquot of the purified amplicon is then available for the subsequent cloning step. Suitable cloning vectors are generally known to the skilled worker. These include, in particular, vectors which are capable of replication in microbial systems, that is to say mainly vectors which ensure efficient cloning in yeasts or fungi and which make possible the stable transformation of plants. Those which must be mentioned in particular are various binary and cointegrated vector systems which are suitable for the T-DNA-mediated transformation. Such vector systems are, as a rule, characterized in that they comprise at least the vir genes required for the *Agrobacterium*-mediated transformation and the T-DNA-delimiting sequences (T-DNA border). These vector systems preferably also comprise further cis-regulatory regions such as promoters and terminators and/or selection markers, by means of which suitably transformed organisms can be identified. While in the case of cointegrated vector systems vir genes and T-DNA sequences are arranged on the same vector, binary systems are based on at least two vectors, one of which bears vir genes, but no T-DNA, while a second one bears T-DNA, but no vir genes. Owing to this fact, the last-mentioned vectors are relatively small, easy to manipulate and capable of replication both in *E. coli* and in *Agrobacterium*. These binary vectors include vectors from the series pBIB-HYG, pPZP, pBecks, pGreen. In accordance with the invention, pBin19, pBI101, pBinAR, pGPTV and pCAMBIA are used by preference. An overview of the binary vectors and their use is found in Hellens et al. (2000) Trends in Plant Science 5: 446-451.

In order to prepare the vectors, the vectors can first be linearized with restriction endonuclease(s) and then modified enzymatically in a suitable manner. Thereafter, the vector is purified, and an aliquot is employed for the cloning step. In the cloning step, the enzymatically cleaved and, if appropriate, purified amplificate is cloned with vector fragments which have been prepared in a similar manner, using ligase. In this context, a particular nucleic acid construct, or vector or plasmid construct, can have one or more than one codogenic gene segments. The codogenic gene segments in these constructs are preferably linked operably with regulatory sequences. The regulatory sequences include, in particular, plant sequences such as the above-described promoters and terminators. The constructs can advantageously be stably propagated in microorganisms, in particular *Escherichia coli* and *Agrobacterium tumefaciens*, under selective conditions and thus make possible the transfer of heterologous DNA into plants.

The nucleic acid sequences and nucleic acid constructs used in the inventive process can be introduced into microorganisms and then into plants, advantageously using cloning vectors, and thus be used in the transformation of plants such as those which are published in and cited therein: Plant Molecular Biology and Biotechnology (CRC Press, Boca Raton, Fla.), Chapter 6/7, p. 71-119 (1993); F. F. White, Vectors for Gene Transfer in Higher Plants; in: Transgenic Plants, Vol 1, Engineering and Utilization, Ed.: Kung and R. Wu, Academic Press, 1993, 15-38; B. Jenes et al., Techniques for Gene Transfer, in: Transgenic Plants, Vol. 1, Engineering and Utilization, Ed.: Kung and R. Wu, Academic Press (1993), 128-143; Potrykus, Annu. Rev. Plant Physiol. Plant Molec. Biol. (1991) 42: 205-225. Thus, the nucleic acids, nucleic acid constructs and/or vectors used in the process can be used for the recombinant modification of a broad spectrum of plants so that the latter become better and/or more efficient LCPUFA producers.

Owing to the introduction of a Δ6-desaturase, Δ6-elongase, Δ5-desaturase and Δ5-elongase gene into a plant, alone or in combination with other genes, it is not only possible to increase biosynthesis flux towards the end product, but also to increase, or to create de novo the corresponding triacylglycerol and/or phosphatidylester composition. Likewise, the number or activity of other genes which are involved in the import of nutrients which are required for the biosynthesis of one or more fatty acids, oils, polar and/or neutral lipids, can be increased, so that the concentration of these precursors, cofactors or intermediates within the cells or within the storage compartment is increased, whereby the ability of the cells to produce PUFAs, as described below, is enhanced further. By optimizing the activity or increasing the number of one or more of the Δ6-desaturase, Δ6-elongase, Δ5-desaturase and/or Δ5-elongase genes which are involved in the biosynthesis of these compounds, or by destroying the activity of one or more genes which are involved in the degradation of these compounds, it may be possible to increase the yield, production and/or production efficiency in fatty acid and lipid molecules from organisms and advantageously from plants.

The nucleic acid molecules used in the process of the invention code for proteins or parts thereof, whereas the proteins or the individual protein or parts thereof comprises an amino acid sequence which has sufficient homology to an amino acid sequence which is depicted in the sequences SEQ ID NO: 65, SEQ ID NO: 2, SEQ ID NO: 172 or SEQ ID NO: 52 and, if appropriate, SEQ ID NO: 194 or SEQ ID NO: 78, so that the proteins or parts thereof still have a Δ-6-desaturase, Δ-6-elongase, Δ-5-desaturase and/or Δ-5-elongase activity and, if appropriate, a Δ-4-desaturase and/or ω-3-desaturase activity. The proteins or parts thereof which is/are encoded by the nucleic acid molecule/nucleic acid molecules preferably still have its/their essential enzymatic activity and the ability to participate in the metabolism of compounds necessary for constructing cell membranes or lipid bodies in organisms, advantageously in plants, or in the transport of molecules across these membranes. The proteins encoded by the nucleic acid molecules are at least about 60% and preferably at least about 70%, 80% or 90%, and particularly preferably at least about 85%, 86%, 87%, 88%, 89%, 90%, 91%, 92%, 93%, 94%, 95%, 96%, 97%, 98%, 99% or more identical to the amino acid sequences depicted in SEQ ID NO: 65, SEQ ID NO: 2, SEQ ID NO: 172, SEQ ID NO: 52, SEQ ID NO: 194 or SEQ ID NO: 78. Homology or homologous means in the context of the invention identity or identical.

The homology was calculated over the entire amino acid or nucleic acid sequence region. To compare various sequences, the skilled worker has available a series of programs which are based on various algorithms. The algorithms of Needleman and Wunsch or Smith and Waterman give particularly reliable results. The program PileUp (J. Mol. Evolution. (1987) 25: 351-360; Higgins et al. (1989) CABIOS 5: 151-153) or the programs Gap and BestFit (Needleman and Wunsch (1970) J. Mol. Biol. 48: 443-453 and Smith and Waterman (1981) Adv. Appl. Math. 2: 482-489), which are part of the GCG software packet [Genetics Computer Group, 575 Science Drive, Madison, Wis., USA 53711 (1991)], were used to carry out the sequence comparisons. The sequence homology data given above in % were determined over the entire sequence region using the program GAP with the following settings: Gap Weight: 50, Length Weight: 3, Average Match: 10.000 and Average Mismatch: 0.000. Unless otherwise specified, these settings were always used as standard settings for sequence comparisons.

Essential enzymatic activity of the ω-3-desaturase, Δ-6-desaturase, Δ-6-elongase, Δ-5-elongase, Δ-4-desaturase and/or Δ-5-desaturase used in the process of the invention means that, compared with the proteins/enzymes encoded by the sequence having SEQ ID NO: 64, SEQ ID NO: 1, SEQ ID NO: 171, SEQ ID NO: 51, SEQ ID NO: 193 or SEQ ID NO: 77, they still have an enzymatic activity of at least 10%, preferably of at least 20%, particularly preferably of at least 30% and most preferably of at least 40, 50 or 60%, and thus are able to participate in the metabolism of compounds necessary for synthesizing fatty acids, advantageously fatty acid esters such as phosphatidyl esters and/or triacylglyceride esters, in a plant or plant cell, or in the transport of molecules across membranes.

Nucleic acids which can be advantageously used in the process are derived from bacteria, fungi, diatoms, animals such as *Caernorhabditis* or *Oncorhynchus* or plants such as algae or mosses such as the genera *Shewanella, Physcomitrella, Thraustochytrium, Fusarium, Phytophthora, Ceratodon, Pytium irregulare, Mantoniella, Ostreococcus, Isochrysis, Aleurita, muscarioides, Mortierella, Borago, Phaeodactylum, Crypthecodinium*, specifically from the genera and species *Pytium irregulare, Oncorhynchus mykiss, Xenopus laevis, Ciona intestinalis, Thalassiosira pseudonona, Mantoniella squamata, Ostreococcus* sp., *Ostreococcus tauri, Euglena gracilis, Physcomitrella patens, Phytophtora infestans, Fusarium graminaeum, Cryptocodinium cohnii, Ceratodon purpureus, Isochrysis galbana, Aleurita farinosa, Thraustochytrium* sp., *Muscarioides viallii, Mortierella alpina, Borago officinalis, Phaeodactylum tricornutum, Caenorhabditis elegans* or particularly advantageously from *Pytium irregulare, Thraustochytrium* sp. and/or *Ostreococcus tauri*.

It is possible additionally to use in the process of the invention nucleotide sequences which code for a Δ-12-desaturase, Δ-9-elongase or Δ-8-desaturase. The nucleic acid sequences used in the process are advantageously introduced in an expression cassette which makes expression of the nucleic acids in plants possible.

The nucleic acid sequences which code for the Δ-12-desaturase, ω-3-desaturase, Δ-9-elongase, Δ-6-desaturase, Δ-8-desaturase, Δ-6-elongase, Δ-5-desaturase, Δ-5-elongase or Δ-4-desaturase are functionally linked to one or more regulatory signals to increase the gene expression. These regulatory sequences are intended to make targeted expression of the genes possible. This may mean for example, depending on the plant, that the gene is expressed and/or overexpressed only after induction, or that it is expressed and/or overexpressed immediately. Sequences advantageously used for the expression make constitutive expression possible, such as CaMV35S, CaMV36S, CaMV35Smas, nos, mas, ubi, stpt, lea or Super promoter. Expression preferably takes place in vegetative tissue as described above. In another preferred embodiment, the expression takes place in seeds.

These regulatory sequences are for example sequences to which inducers or repressors bind and thus regulate the expression of the nucleic acid. In addition to the regulatory sequences which are not linked in their natural locus to the nucleic acid sequences, or instead of these sequences, the natural regulation of these sequences may still be present before the actual structural genes and, if appropriate, have been genetically modified so that natural regulation is switched off and expression of the genes is increased. The gene construct may additionally advantageously also comprise one or more so-called "enhancer sequences" functionally linked to the promoter, which make increased expression of the nucleic acid sequence possible. Additional advantageous sequences can also be inserted at the 3' end of the DNA sequences, such as further regulatory elements or terminators. Advantageous terminators are for example viral terminators such as the 35S terminator or others. The nucleic acid sequences used in the process according to the invention may be present in one or more copies of the expression cassette (=gene construct). Preferably, only one copy of the genes is present in each expression cassette. This gene construct, or the gene constructs, can be introduced into the plant simultaneously or successively and expressed together in the host organism. In this context, the gene construct(s) can be inserted in one or more vectors and be present in the cell in free form, or else be inserted in the genome. It is advantageous for the insertion of further genes in the plant when the genes to be expressed are present together in one gene construct. However, it is also possible to introduce in each case one gene construct containing a nucleic acid sequence into a plant and to cross the resulting plants with one another in order to obtain progeny which contains all gene constructs together.

In this context, the regulatory sequences or factors can, as described above, preferably have a positive effect on the gene expression of the genes introduced, thus enhancing it. Thus, an enhancement of the regulatory elements, advantageously at the transcriptional level, may take place by using strong transcription signals such as promoters and/or enhancers. In addition, however, enhanced translation is also possible, for example by improving the stability of the mRNA.

To ensure the stable integration of the biosynthesis genes into the transgenic plant over a plurality of generations, each of the nucleic acids which encode Δ6-desaturase, Δ6-elongase, Δ5-desaturase or Δ5-elongase and if appropriate the ω3-desaturase or Δ4-desaturase and which are used in the process should be expressed under the control of a separate promoter. This can be identical or different for each of the sequences. In this context, the expression cassette is advantageously constructed in such a way that a promoter is followed by a suitable cleavage site for insertion of the nucleic acid to be expressed, which cleavage site is advantageously in a polylinker. If appropriate, a terminator can be positioned behind the polylinker. This sequence is repeated several times, preferably three, four, five or six times, so that up to six genes can be combined in one construct and thus introduced into the transgenic plant in order to be expressed. To express the nucleic acid sequences, the latter are inserted behind the promoter via the suitable cleavage site, for example in the polylinker. Advantageously, each nucleic acid sequence has its own promoter and, if appropriate, its own terminator. However, it is also possible to insert a plurality of nucleic acid sequences behind a promoter and, if appropriate, before a terminator. Here, the insertion site, or the sequence, of the inserted nucleic acids in the expression cassette is not of critical importance, that is to say a nucleic acid sequence can be inserted at the first or last position in the cassette without the expression being substantially influenced by the position. In an advantageous embodiment, different promoters such as, for example, the USP, LegB4 or DC3 promoter, and different terminators can be used in the expression cassette. In a further advantageous embodiment, identical promoters such as the CaMV35S promoter can also be used.

As described above, the transcription of the genes which have been introduced should advantageously be terminated by suitable terminators at the 3' end of the biosynthesis genes which have been introduced (behind the stop codon). An example of a sequence which can be used in this context is the OCS 1 or the 35SCaMV terminator. As is the case with the promoters, different terminator sequences should be used here for each gene.

As described above, the gene construct can also comprise further genes to be introduced into the organisms. It is possible and advantageous to introduce into the host plants, and to express therein, regulatory genes such as genes for inductors, repressors or enzymes which, owing to their enzyme activity, engage in the regulation of one or more genes of a biosynthesis pathway. These genes can be of heterologous or of homologous origin. Moreover, further biosynthesis genes of the fatty acid or lipid metabolism can advantageously be present in the nucleic acid construct, or gene construct or alternatively, these genes can also be present on one further or more further nucleic acid constructs. A biosynthesis gene of the fatty acid or lipid metabolism which is preferably chosen is one or more genes selected from the group of acyl-CoA dehydrogenase(s), acyl-ACP [=acyl carrier protein] desaturase(s), acyl-ACP thioesterase(s), fatty acid acyl-transferase(s), acyl-CoA:lysophospholipid acyltransferases, fatty acid synthase(s), fatty acid hydroxylase(s), acetyl-coenzyme A carboxylase(s), acyl-coenzyme A oxidase(s), fatty acid desaturase(s), fatty acid acetylenases, lipoxygenases, triacylglycerol lipases, allenoxide synthases, hydroperoxide lyases or fatty acid elongase(s) or combinations thereof. Especially advantageous nucleic acid sequences are biosynthesis genes of the fatty acid or lipid metabolism selected from the group of the acyl-CoA:lysophospholipid acyltransferase, Δ8-desaturase, Δ9-desaturase, Δ12-desaturase and/or Δ9-elongase.

In this context, the abovementioned nucleic acids or genes can be cloned into expression cassettes, like those mentioned above, in combination with other elongases and desaturases and used for transforming plants with the aid of *Agrobacterium*.

The term "vector" used in this description relates to a nucleic acid molecule which is capable of transporting another nucleic acid to which it is bound. One type of vector is a "plasmid", a circular double-stranded DNA loop into which additional DNA segments can be ligated. A further type of vector is a viral vector, it being possible for additional DNA segments to be ligated into the viral genome. Certain vectors are capable of autonomous replication in a host cell into which they have been introduced (for example bacterial vectors with bacterial replication origin). Other vectors are advantageously integrated into the genome of a host cell when they are introduced into the host cell, and thus replicate together with the host genome. Moreover, certain vectors can govern the expression of genes with which they are in operable linkage. These vectors are referred to in the present context as "expression vectors". Usually, expression vectors which are suitable for DNA recombination techniques take the form of plasmids. In the present description, "plasmid" and "vector" can be used exchangeably since the plasmid is the form of vector which is most frequently used. However, the invention is also intended to cover other forms of expression vectors, such as viral vectors, which exert similar functions. Furthermore, the term vector is also intended to encompass other vectors with which the skilled worker is familiar, such as phages, viruses such as SV40, CMV, TMV, transposons, IS elements, phasmids, phagemids, cosmids, linear or circular DNA.

The recombinant expression vectors advantageously used in the process comprise the nucleic acid sequences or the above-described gene construct used in the process in a form which is suitable for expressing the nucleic acids used in a host cell, which means that the recombinant expression vectors comprise one or more regulatory sequences, which are selected on the basis of the host cells to be used for the expression, which regulatory sequence(s) is/are linked operably with the nucleic acid sequence to be expressed. In a recombinant expression vector, "linked operably" means that the nucleotide sequence of interest is bound to the regulatory sequence(s) in such a way that the expression of the nucleotide sequence is made possible and they are bound to each other in such a way that both sequences carry out the predicted function which is ascribed to the sequence (for example in an in-vitro transcription/translation system, or in a host cell if the vector is introduced into the host cell). The term "regulatory sequence" is intended to comprise promoters, enhancers and other expression control elements (for example polyadenylation signals). These regulatory sequences are described, for example, in Goeddel: Gene Expression Technology: Methods in Enzymology 185, Academic Press, San Diego, Calif. (1990), or see: Gruber and Crosby, in: Methods in Plant Molecular Biology and Biotechnology, CRC Press, Boca Raton, Fla., Ed.: Glick and Thompson, Chapter 7, 89-108, including the references cited therein. Regulatory sequences comprise those which govern the constitutive expression of a nucleotide sequence in many types of host cell and those which govern the direct expression of the nucleotide sequence only in specific host cells under specific conditions. The skilled worker knows that the design of the expression vector can depend on factors such as the choice of host cell to be transformed, the desired degree of expression of the protein and the like.

The recombinant expression vectors used can be designed for the expression of the nucleic acid sequences used in the process in such a way that they can be transformed into prokaryotic intermediate hosts and finally, after introduction into the plants, make expression of the genes possible therein. This is advantageous because on account of simplicity, intermediate steps in vector construction are frequently carried out in microorganisms. For example, the Δ-6-desaturates, Δ-6-elongase, Δ-5-desaturate and/or Δ-5-elongase genes can be expressed in bacterial cells, insect cells (using baculovirus expression vectors), yeast cells and other fungal cells (see Romanos, M. A., et al. (1992) Yeast 8:423-488; van den Hondel, C. A. M. J. J., et al. (1991) "Heterologous gene expression in filamentous fungi", in: More Gene Manipulations in Fungi, J. W. Bennet & L. L. Lasure, Editors, pp. 396-428: Academic Press: San Diego; and van den Hondel, C. A. M. J. J., & Punt, P. J. (1992) "Gene transfer systems and vector development for filamentous fungi, in: Applied Molecular Genetics of Fungi, Peberdy, J. F., et al., Editors, pp. 1-28, Cambridge University Press: Cambridge), Algae (Falciatore et al. (1999) Marine Biotechnology. 1: (3):239-251), ciliates, with vectors following a transformation process as described in WO 98/01572, and preferably in cells of multicellular plants (see Schmidt, R. and Willmitzer, L. (1988) "High efficiency Agrobacterium tumefaciens-mediated transformation of Arabidopsis thaliana leaf and cotyledon explants" Plant Cell Rep.:538-586; Plant Molecular Biology and Biotechnology, C Press, Boca Raton, Fla., chapter 6/7, pp. 71-119 (1993); F. F. White, B. Jenes et al., Techniques for Gene Transfer in: Transgenic Plants, vol. 1, Engineering and Utilization, Editors.: Kung and R. Wu, Academic Press (1993), 128-43; Potrykus (1991) Annu. Rev. Plant Physiol. Plant Molec. Biol. 42: 205-225 (and references cited therein)). Suitable hosts are what are further discussed in Goeddel, Gene Expression Technology: Methods in Enzymology 185, Academic Press, San Diego, Calif. (1990). The recombinant expression vector may alternatively be transcribed and translated in vitro for example using T7 promoter regulatory sequences and T7 polymerase.

Expression of proteins in prokaryotes usually takes place with vectors which comprise constitutive or inducible promoters which control the expression of fusion or non-fusion proteins. Typical fusion expression vectors are inter alia pGEX (Pharmacia Biotech Inc; Smith, D. B., and Johnson, K. S. (1988) Gene 67:31-40), pMAL (New England Biolabs, Beverly, Mass.) and pRIT5 (Pharmacia, Piscataway, N.J.), of which glutathione S-transferase (GST), maltose E-binding protein and protein A, respectively, are fused to the recombinant target protein.

Examples of suitable inducible non-fusion E. coli expression vectors are inter alia pTrc (Amann et al. (1988) Gene 69:301-315) and pET 11d (Studier et al., Gene Expression Technology: Methods in Enzymology 185, Academic Press, San Diego, Calif. (1990) 60-89). Target gene expression by the pTrc vector is based on transcription by host RNA polymerase from a hybrid trp-lac fusion promoter. Target gene expression from the pET 11d vector is based on transcription from a T7-gn10-lac fusion promoter which is mediated by a coexpressed viral RNA polymerase (T7 gn1). This viral polymerase is provided by the host strains BL21 (DE3) or HMS174 (DE3) from a resident λ prophage which harbors a T7 gn1 gene under transcription control of the lacUV 5 promoter.

Other vectors suitable in prokaryotic organisms are known to the skilled worker; these vectors are for example in E. coli pLG338, pACYC184, the pBR series such as pBR322, the pUC series such as pUC18 or pUC19, the M113mp series, pKC30, pRep4, pHSI, pH52, pPLc236, pMBL24, pLG200, pUR290, pIN-III113-B1, λgt11 or pBdCI, in streptomyces pIJ101, pIJ364, pIJ702 or pIJ361, in bacillus pUB110, pC194 or pBD214, in corynebacterium pSA77 or pAJ667.

In a further embodiment, the expression vector is a yeast expression vector. Examples of vectors for expression in the yeast S. cerevisiae include pYeDesaturasec1 (Baldari et al. (1987) Embo J. 6:229-234), pMFa (Kurjan and Herskowitz (1982) Cell 30:933-943), pJRY88 (Schultz et al. (1987) Gene 54:113-123) and pYES2 (Invitrogen Corporation, San Diego, Calif.). Vectors and processes for constructing vectors suitable for use in other fungi, such as the filamentous fungi, are described in detail in: van den Hondel, C. A. M. J. J., & Punt, P. J. (1991) "Gene transfer systems and vector development for filamentous fungi, in: Applied Molecular Genetics of fungi, J. F. Peberdy et al., editors, pp. 1-28, Cambridge University Press: Cambridge, or in: More Gene Manipulations in Fungi (J. W. Bennet & L. L. Lasure, Editors, pp. 396-428: Academic Press: San Diego). Further suitable yeast vectors are for example pAG-1, YEp6, YEp13 or pEMBLYe23.

Alternatively, the nucleic acid sequences used in the process of the invention can be expressed in insect cells using baculovirus expression vectors. Baculovirus vectors available for expressing proteins in cultured insect cells (e.g. Sf9 cells) include the pAc series (Smith et al. (1983) Mol. Cell. Biol. 3:2156-2165) and the pVL series (Lucklow and Summers (1989) Virology 170:31-39).

The above mentioned vectors provide only a small survey of possible suitable vectors. Further plasmids are known to the skilled worker and are described for example in: Cloning Vectors (Editors Pouwels, P. H. et al., Elsevier, Amsterdam-New York-Oxford, 1985, ISBN 0 444 904018). Further suitable expression systems for prokaryotic and eukaryotic cells see in chapters 16 and 17 of Sambrook, J., Fritsch, E. F., and Maniatis, T., Molecular Cloning: A Laboratory Manual, 2nd edition, Cold spring Harbor Laboratory, Cold Spring Harbor Laboratory Press, Cold Spring Harbor, N.Y., 1989.

The genes used in the process can also be expressed in single-celled plant cells (such as algae), see Falciatore et al. (1999) Marine Biotechnology 1 (3):239-251 and references cited therein, and in plant cells from higher plants (for example spermatophytes such as arable crops). Examples of plant expression vectors comprise those which are described in detail in: Becker, D., Kemper, E., Schell, J., and Masterson, R. (1992) Plant Mol. Biol. 20:1195-1197; and Bevan, M. W. (1984) Nucl. Acids Res. 12:8711-8721; Vectors for Gene Transfer in Higher Plants; in: Transgenic Plants, Vol. 1, Engineering and Utilization, Ed.: Kung and R. Wu, Academic Press, 1993, p. 15-38.

A plant expression cassette preferably comprises regulatory sequences which are capable of governing the expression of genes in plant cells and are linked operably so that each sequence can fulfil its function, such as transcriptional termination, for example polyadenylation signals. Preferred polyadenylation signals are those which are derived from *Agrobacterium tumefaciens* T-DNA, such as gene 3 of the Ti plasmid pTiACH5 (Gielen et al., (1984) EMBO J. 3 835 et seq.), which is known as octopine synthase, or functional equivalents thereof, but all other terminators which are functionally active in plants are also suitable.

Since the regulation of plant gene expression is very often not limited to the transcriptional level, a plant expression cassette preferably comprises other sequences which are linked operably, such as translation enhancers, for example the overdrive sequence, which enhances the tobacco mosaic virus 5'-untranslated leader sequence, which increases the protein/RNA ratio (Gallie et al. (1987) Nucl. Acids Research 15:8693-8711).

As described above, the plant gene expression must be linked operably with a suitable promoter which controls gene expression. Advantageously utilizable promoters are constitutive promoters (Benfey et al., EMBO J. (1989) δ: 2195-2202), such as those which are derived from plant viruses, such as 35S CaMV (Franck et al. (1980) Cell 21: 285-294), 19S CaMV (see also U.S. Pat. No. 5,352,605 and WO 84/02913), or plant promoters, such as the promoter of the Rubisco small subunit, which is described in U.S. Pat. No. 4,962,028.

Other preferred sequences for use for functional connection in plant gene expression cassettes are targeting sequences which are necessary for guiding the gene product into its appropriate cellular compartment, for example into the vacuoles, the cell nucleus, all types of plastids such as amyloplasts, chloroplasts, chromoplasts, the extracellular space, the mitochondria, the endoplasmic reticulum, oil bodies, peroxisomes and other compartments of plant cells; (see a review in Kermode (1996) Crit. Rev. Plant Sci. 15(4): 284-423 and literature cited therein).

Vector DNA can be introduced into prokaryotic or eukaryotic cells via traditional transformation or transfection techniques. The terms "transformation" and "transfection", conjugation and transduction as used in the present context are intended to encompass the multiplicity of prior-art methods for introducing heterologous nucleic acids (for example DNA) into a host cell, including calcium phosphate or calcium chloride coprecipitation, DEAE-dextran-mediated transfection, lipofection, natural competence, chemically mediated transfer, electroporation or particle bombardment. Suitable methods for the transformation or transfection of host cells, including plant cells, can be found in Sambrook et al. (Molecular Cloning: A Laboratory Manual., $2^{nd}$ Ed., Cold Spring Harbor Laboratory, Cold Spring Harbor Laboratory Press, Cold Spring Harbor, N.Y., 1989) and other laboratory manuals such as Methods in Molecular Biology, 1995, Vol. 44, *Agrobacterium* protocols, Ed: Gartland and Davey, Humana Press, Totowa, N.J.

The term "nucleic acid (molecule)" as used herein comprises in an advantageous embodiment additionally the untranslated sequence located at the 3' end and at the 5' end of the coding gene region: at least 500, preferably 200, particularly preferably 100 nucleotides of the sequence upstream of the 5' end of the coding region and at least 100, preferably 50, particularly preferably 20 nucleotides of the sequence downstream of the 3' end of the coding gene region. An "isolated" nucleic acid molecule is separated from other nucleic acid molecules which are present in the natural source of the nucleic acid. An "isolated" nucleic acid preferably has no sequences which naturally flank the nucleic acid in the genomic DNA of the organism from which the nucleic acid is derived (e.g. sequences located at the 5' and 3' ends of the nucleic acid). In various embodiments, the isolated Δ-6-desaturase, Δ-6-elongase or Δ-5-desaturase and, if appropriate, the ω-3-desaturase or Δ-4-desaturase molecule used in the process may for example comprise less than about 5 kb, 4 kb, 3 kb, 2 kb, 1 kb, 0.5 kb or 0.1 kb of nucleotide sequences which naturally flank the nucleic acid molecule in the genomic DNA of the cell from which the nucleic acid is derived.

The nucleic acid molecules used in the process can be isolated by using standard techniques of molecular biology and the sequence information provided herein. It is also possible for example with the aid of comparative algorithms to identify a homologous sequence or homologous, conserved sequence regions at the DNA or amino acid level. These can be used as hybridization probe in standard hybridization techniques (as described for example in Sambrook et al., Molecular Cloning: A Laboratory Manual, 2nd edition, Cold Spring Harbor Laboratory, Cold Spring Harbor Laboratory Press, Cold Spring Harbor, N. Y., 1989) for isolating further nucleic acid sequences useful in the process. The nucleic acid molecule used in the process, or parts thereof, can moreover be isolated by polymerase chain reaction, in which case oligonucleotide primers based on this sequence or on parts thereof are used (e.g. a nucleic acid molecule comprising the complete sequence or a part thereof can be isolated by polymerase chain reaction using oligonucleotide primers which have been constructed on the basis of this identical sequence). For example, mRNA can be isolated from cells (e.g. by the guanidinium thiocyanate extraction method of Chirgwin et al. (1979) Biochemistry 18:5294-5299) and cDNA can be prepared with the aid of reverse transcriptase (e.g. Moloney MLV reverse transcriptase obtainable from Gibco/BRL, Bethesda, Md. or AMV reverse transcriptase, obtainable from Seikagaku America, Inc., St. Petersburg, Fla.). Synthetic oligonucleotide primers for amplification by means of polymerase chain reaction can be constructed on the basis of one of the sequences shown in SEQ ID NO: 64, SEQ ID NO: 1, SEQ ID NO: 171, SEQ ID NO: 51, SEQ ID NO: 193 or SEQ ID NO: 77 or with the aid of the amino acid sequences depicted in SEQ ID NO: 65, SEQ ID NO: 2, SEQ ID NO: 172, SEQ ID NO: 52, SEQ ID NO: 194 or SEQ ID NO: 78. A nucleic acid of the invention can be amplified by standard PCR amplification techniques using cDNA or alternatively genomic DNA as template and suitable oligonucleotide primers. The nucleic acid amplified in this way can be cloned into a suitable vector and characterized by DNA sequence analysis. Oligonucleotides can be prepared by standard synthetic methods, for example using an automatic DNA synthesizer.

Homologs of the Δ-5-elongase, ω-3-desaturase, Δ-6-desaturase, Δ-6-elongase, Δ-4-desaturase or Δ-5-desaturase nucleic acid sequences used, having the sequence SEQ ID NO: 64, SEQ ID NO: 1, SEQ ID NO: 171, SEQ ID NO: 51, SEQ ID NO: 193 or SEQ ID NO: 77, mean for example allelic variants having at least about 40, 50 or 60%, preferably at least about 60 or 70%, more preferably at least about 70 or 80%, 90% or 95% and even more preferably at least 85%, 86%, 87%, 88%, 89%, 90%, 91%, 92%, 93%, 94%, 95%, 96%, 97%, 98%, 99% or more identity or homology to one of the nucleotide sequences shown in SEQ ID NO: 64, 66, 68 or 70, to one of the nucleotide sequences shown in SEQ ID NO: 1, 3, 5, 7, 9, 11, 13, 15, 17, 19, 21, 23, 25, 27, 29, 31, 33, 35, 37, 39 or 41, to one of the nucleotide sequences shown in SEQ ID NO: 171, 173, 175, 177, 179, 181 or 183, to one of the nucleotide sequences shown in SEQ ID NO: 51, 53 or 55, to one of the nucleotide sequences shown in SEQ ID NO: 193 or 195 or to one of the nucleotide sequences shown in or SEQ ID NO: 77, 79, 81, 83, 85, 87, 89, 91 or 93, especially the nucleotide sequences shown in SEQ ID NO: 64, SEQ ID NO: 1, SEQ ID NO: 171, SEQ ID NO: 51, SEQ ID NO: 193 or SEQ ID NO: 77, or their homologs, derivatives or analogs or parts thereof. Also included are isolated nucleic acid molecules of a nucleotide sequence which hybridize for example under stringent conditions to one of the nucleotide sequences shown in SEQ ID NO: 64, SEQ ID NO: 1, SEQ ID NO: 171, SEQ ID NO: 51, SEQ ID NO: 193 or SEQ ID NO: 77 or a part thereof. A part means in this connection according to the invention that at least 25 base pairs (=bp), 50 bp, 75 bp, 100 bp, 125 bp or 150 bp, preferably at least 175 bp, 200 bp, 225 bp, 250 bp, 275 bp or 300 bp, particularly preferably 350 bp, 400 bp, 450 bp, 500 bp or more base pairs are used for the hybridization. It is also possible advantageously to use the complete sequence. Allelic variants comprise in particular functional variants which can be obtained by deletion, insertion or substitution of nucleotides from the sequence depicted in SEQ ID NO: 64, SEQ ID NO: 1, SEQ ID NO: 171, SEQ ID NO: 51, SEQ ID NO: 193 or SEQ ID NO: 77, but where the enzyme activity of the proteins encoded thereby is substantially retained for the insertion.

Nucleic acid molecules advantageous for the process of the invention can be isolated on the basis of their homology to the ω-3-desaturase, Δ-6-desaturase, Δ-5-desaturase, Δ-5-elongase, Δ-4-desaturase and/or Δ-6-elongase nucleic acid sequences disclosed herein by using the sequences or a part thereof as hybridization probe in standard hybridization techniques under stringent hybridization conditions. It is possible in this connection for example to use isolated nucleic acid molecules which are at least 15 nucleotides long and hybridize under stringent conditions with the nucleic acid molecules which comprise a nucleotide sequence of SEQ ID NO: 64, SEQ ID NO: 1, SEQ ID NO: 171, SEQ ID NO: 51, SEQ ID NO: 193 or SEQ ID NO: 77. It is also possible to use nucleic acid molecules having at least 25, 50, 100, 250 or more nucleotides.

The term "hybridizes under stringent conditions" as used herein is intended to describe hybridization and washing conditions under which nucleic acid sequences which are at least 60% mutually homologous normally remain hybridized together. The conditions are preferably such that sequences which are at least about 65%, preferably at least about 70% and particularly preferably at least about 75% or more mutually homologous normally remain hybridized together. These stringent conditions are known to the skilled worker and can be found in Current Protocols in Molecular Biology, John Wiley & Sons, N.Y. (1989), 6.3.1-6.3.6. A preferred, non-restrictive example of stringent hybridization conditions are hybridizations in 6× sodium chloride/sodium citrate (=SSC) at about 45° C., followed by one or more washing steps in 0.2×SSC, 0.1% SDS at 50 to 65° C. The skilled worker is aware that these hybridization conditions differ depending on the type of nucleic acid and, for example organic solvents are present, in relation to the temperature and the concentration of the buffer. The temperature for example under "standard hybridization conditions" is, depending on the type of nucleic acid, between 42° C. and 58° C. in aqueous buffer with a concentration of 0.1 to 5×SSC (pH 7.2). If organic solvent, for example 50% formamide, is present in the abovementioned buffer, the temperature under standard conditions is about 42° C. The hybridization conditions for DNA:DNA hybrids are preferably for example 0.1×SSC and 20° C. to 45° C., preferably 30° C. to 45° C. The hybridization conditions for DNA:RNA hybrids are preferably for example 0.1×SSC and 30° C. to 55° C., preferably 45° C. to 55° C. The aforementioned hybridization temperatures are determined for example for a nucleic acid with a length of about 100 bp (=base pairs) and a G+C content of 50% in the absence of formamide. The skilled person knows how the necessary hybridization conditions can be determined on the basis of textbooks such as the abovementioned or from the following textbooks Sambrook et al., "Molecular Cloning", Cold Spring Harbor Laboratory, 1989; Hames and Higgins (editors) 1985, "Nucleic Acids Hybridization: A Practical Approach", IRL Press at Oxford University Press, Oxford; Brown (editor) 1991, "Essential Molecular Biology: A Practical Approach", IRL Press at Oxford University Press, Oxford.

In order to determine the percentage of homology (=identity) of two amino acid sequences (for example one of the sequences of SEQ ID NO: 65, SEQ ID NO: 2, SEQ ID NO: 172, SEQ ID NO: 52, SEQ ID NO: 194 or SEQ ID NO: 78) or of two nucleic acids (for example SEQ ID NO: 64, SEQ ID NO: 1, SEQ ID NO: 171, SEQ ID NO: 51, SEQ ID NO: 193 or SEQ ID NO: 77), the sequences are written one under the other in order to be able to compare them optimally (for example, gaps may be introduced into the sequence of a protein or of a nucleic acid in order to generate optimal alignment with the other protein or the other nucleic acid). Then, the amino acid radicals or nucleotides at the corresponding amino acid positions or nucleotide positions are compared. If a position in a sequence is occupied by the same amino acid radical or the same nucleotide as the corresponding position in another sequence, then the molecules are homologous at this position (i.e. amino acid or nucleic acid "homology" as used in the present context corresponds to amino acid or nucleic acid "identity"). The percentage of homology between the two sequences is a function of the number of identical positions which the sequences share (i.e. % homology=number of identical positions/total number of positions×100). The programs and algorithms used to determine the homology are described above.

An isolated nucleic acid molecule which codes for an ω-3-desaturase, Δ-6-desaturase, Δ-5-desaturase, Δ-5-elongase, Δ-4-desaturase and/or Δ-6-elongase which is used in the process and which is homologous to a protein sequence of SEQ ID NO: 65, SEQ ID NO: 2, SEQ ID NO: 172, SEQ ID NO: 52, SEQ ID NO: 194 or SEQ ID NO: 78 can be generated by introducing one or more nucleotide substitutions, additions or deletions into a nucleotide sequence of SEQ ID NOT NO: 64, SEQ ID NO: 1, SEQ ID NO: 171, SEQ ID NO: 51, SEQ ID NO: 193 or SEQ ID NO: 77, so that one or more amino acid substitutions, additions or deletions are introduced into the encoded protein. Mutations may be introduced into one of the sequences of SEQ ID NO: 64, SEQ ID NO: 1, SEQ ID NO: 171, SEQ ID NO: 51, SEQ ID NO: 193 or SEQ ID NO: 77 by standard techniques such as site-specific mutagenesis and PCR-mediated mutagenesis. Conservative amino acid substitutions are preferably produced at one or more of the predicted nonessential amino acid residues. In a "conservative amino acid substitution" the amino acid residue is replaced by an amino acid residue having a similar side chain. Families of amino acid residues having similar side chains have been defined in the art. These families include amino acids with basic side chains (e.g. lysine, arginine, histidine), acidic side chains (e.g. aspartic acid, glutamic acid), uncharged polar side chains (e.g. glycine, asparagine, glutamine, serine, threonine, tyrosine, cysteine), nonpolar side chains (e.g. alanine, valine, leucine, isoleucine, proline, phenylalanine, methionine, tryptophan), beta-branched side chains (e.g. threonine, valine, isoleucine) and aromatic side chains (e.g. tyrosine, phenylalanine, tryptophan, histidine). A predicted nonessential amino acid residue in an ω-3-desaturase, Δ-6-desaturase, Δ-5-desaturase, Δ-5-elongase, Δ-4-desaturase or Δ-6-elongase is thus preferably replaced by another amino acid residue from the same side-chain family. An alternative possibility in another embodiment is to introduce the mutations randomly over the whole or a part of the ω-3-desaturase-, Δ-6-desaturase-, Δ-5-desaturase-, Δ-5-elongase-, Δ-4-desaturase- or Δ-6-elongase-encoding sequence, e.g. by saturation mutagenesis, and the resulting mutants can be screened for the ω-3-desaturase, Δ-6-desaturase, Δ-5-desaturase, Δ-5-elongase, Δ-4-desaturase or Δ-6-elongase activity described herein in order to identify mutants which have retained the ω-3-desaturase, Δ-6-desaturase, Δ-5-desaturase, Δ-5-elongase, Δ-4-desaturase or Δ-6-elongase activity. The encoded protein can be recombinantly expressed after the mutagenesis, and the activity of the protein can be determined for example by using the assays described herein.

The invention is illustrated in greater detail by the examples which follow, which are not to be construed as limiting. The content of all of the references, patent applications, patents and published patent applications cited in the present patent application is herewith incorporated by reference.

The following table shows the sequence identifiers as used in the priority application of Feb. 21, 2006, with the German application number 102006008030.0, and the corresponding sequence identifiers in this subsequent application. The nucleic acid sequence identified by SEQ ID NO: 1 of the priority application corresponds for example to the nucleic acid sequence identified by SEQ ID NO: 64 of the subsequent application.

Table of concordance of sequence identifiers of the priority application and the sequence identifiers in the subsequent application:

| SEQ ID NO: Priority application German application number 102006008030.0 | SEQ ID NO: this subsequent application | Organism |
|---|---|---|
| 1 | 64 | Ostreococcus tauri |
| 2 | 65 | Ostreococcus tauri |
| 3 | 1 | Phytium irregulare |
| 4 | 2 | Phytium irregulare |
| 5 | 171 | Traustochytrium sp. |

-continued

| SEQ ID NO: Priority application German application number 102006008030.0 | SEQ ID NO: this subsequent application | Organism |
|---|---|---|
| 6 | 172 | Traustochytrium sp. |
| 7 | 51 | Thraustochytrium ssp. |
| 8 | 52 | Thraustochytrium ssp. |
| 9 | 193 | Phytophthora infestans |
| 10 | 194 | Phytophthora infestans |
| 11 | 77 | Traustochytrium sp. |
| 12 | 78 | Traustochytrium sp. |
| 13 | 109 | Ostreococcus tauri |
| n.a. | 110 | Ostreococcus tauri |
| 14 | 122 | Ostreococcus tauri |
| n.a. | 123 | Ostreococcus tauri |
| 15 | 143 | Ostreococcus tauri |
| 16 | 144 | Ostreococcus tauri |
| 17 | 161 | Cauliflower mosaic virus |
| 18 | 162 | Cauliflower mosaic virus |
| 19 | 163 | Thalassiosira pseudonana |
| 20 | 164 | Thalassiosira pseudonana |

EXAMPLES

Example 1

General Cloning Methods

The cloning methods such as, for example, restriction cleavages, agarose gel electrophoresis, purification of DNA fragments, transfer of nucleic acids to nitrocellulose and nylon membranes, linkage of DNA fragments, transformation of *Escherichia coli* cells, bacterial cultures and the sequence analysis of recombinant DNA were carried out as described by Sambrook et al. (1989) (Cold Spring Harbor Laboratory Press: ISBN 0-87969-309-6).

Example 2

Sequence Analysis of Recombinant DNA

Recombinant DNA molecules were sequenced with an ABI laser fluorescence DNA sequencer by the method of Sanger (Sanger et al. (1977) Proc. Natl. Acad. Sci. USA 74: 5463-5467). Fragments resulting from a polymerase chain reaction were sequenced and verified to avoid polymerase errors in constructs to be expressed.

Example 3

Cloning of Genes from *Ostreococcus tauri*

It was possible by searching for conserved regions in an *Ostreococcus tauri* sequence database (genomic sequences) in each case a sequence coding for a protein having Δ-5-elongase activity or Δ-6-elongase activity. These are the following sequences:

| Gene name | SEQ ID | Amino acids |
|---|---|---|
| OtELO1.1, (Δ-6-Elongase) | SEQ ID NO: 143 | 292 |
| OtELO2.1, (Δ-5-Elongase) | SEQ ID NO: 109 | 300 |

OtElo2.1 shows greatest similarity to an elongase from Danio rerio (GenBank AAN77156; approx. 26% identity), whereas
OtElo1.1 shows greatest similarity to the elongase from *Physcomitrella* (PSE) (approx. 36% identity) (alignments were carried out with the tBLASTn algorithm (Altschul et al. (1990) J. Mol. Biol. 215: 403-410)).

The cloning of the elongases was carried out as follows:

40 ml of an *Ostreococcus tauri* culture in the stationary phase were spun down and resuspended in 100 μl of double-distilled water and stored at −20° C. The corresponding genomic DNAs were amplified by the PCR method. The corresponding primer pairs were selected so that they harbored the yeast consensus sequence for high-efficiency translation (Kozak (1986) Cell 44: 283-292) beside the start codon. Amplification of the OtElo DNAs was carried out in each case with 1 μl of thawed cells, 200 μM dNTPs, 2.5 U Taq polymerase and 100 pmol of each primer in a total volume of 50 μl. The conditions for the PCR were as follows: first denaturation at 95° C. for 5 minutes, followed by 30 cycles at 94° C. for 30 seconds, 55° C. for 1 minute and 72° C. for 2 minutes, and a final elongation step at 72° C. for 10 minutes.

Example 4

Optimization of Elongase Genes from *Ostreococcus tauri*

Elongases from the organism *Ostreococcus tauri* were isolated as described in example 3. In order to achieve an increase in the content of C22 fatty acids, the sequences SEQ ID NO: 143 (Δ6-elongase) and SEQ ID NO: 109 (coding for a protein identified by SEQ ID NO: 110) (Δ5-elongase) were adapted to the codon usage in oilseed rape, flax and soybean. For this purpose, the amino acid sequence of the Δ6-elongase and of the Δ5-elongase (SEQ ID NO: 144 for the Δ6-elongase; SEQ ID NO: 65 for the Δ5-elongase) was back-translated to obtain degenerate DNA sequences. These DNA sequences were adapted by means of the GeneOptimizer program (from Geneart, Regensburg) to the codon usage in oilseed rape, soybean and flax, taking account of the natural frequency of individual codons. The optimized sequences obtained in this way, which are indicated in SEQ ID NO: 64 (Δ5-elongase) and SEQ ID NO: 122 (coding for a protein identified by SEQ ID NO: 123) (Δ6-elongase) were synthesized in vitro.

Example 5

Cloning of Expression Plasmids for Heterologous Expression in Yeasts

To characterize the function of the optimized nucleic acid sequences, the open reading frames of the respective DNAs were cloned downstream of the galactose-inducible GAL1 promoter of pYES2.1/V5-His-TOPO (Invitrogen), resulting in the plasmids pOTE1.2 (comprising the Δ6-elongase sequence) and pOTE2.2 (comprising the Δ5-elongase sequence).

Overview of the elongase sequences cloned into the yeast vector pYES2.1/V5-His-TOPO:

| Gene name | SEQ ID | Amino acids |
|---|---|---|
| pOTE1.1, (Δ-6-elongase) | SEQ ID NO: 143 | 292 |
| pOTE1.2, (Δ-6-elongase) | SEQ ID NO: 122 | 292, codon-optimized |
| pOTE2.1, (Δ-5-elongase) | SEQ ID NO: 109 | 300 |
| pOTE2.2, (Δ-5-elongase) | SEQ ID NO: 64 | 300, codon-optimized |

The *Saccharomyces cerevisiae* strain 334 was transformed by electroporation (1500 V) with the vectors pOTE1.2 and pOTE2.2 and with the comparative constructs pOTE1.1 and pOTE2.1 which comprise the natural nucleic acid sequence coding for the Δ6-elongase and Δ5-elongase, respectively. A yeast transformed with the empty vector pYES2 was used as control. The transformed yeasts were selected on complete minimal medium (CMdum) agar plates with 2% glucose but without uracil. After the selection, three transformants in each case were selected for further functional expression.

To express the Ot elongases, initially precultures composed of in each case 5 ml of CMdum liquid medium with 2% (w/v) raffinose but without uracil were inoculated with the selected transformants and incubated at 30° C., 200 rpm for 2 days. 5 ml of CMdum liquid medium (without uracil) with 2% raffinose were then inoculated with the precultures to an OD$_{600}$ of 0.05. Moreover, 0.2 mM γ-linolenic acid (GLA) was added in each case to the yeast culture transformed with pOTE1.1 and pOTE1.2. On the basis of the activity of OtELO1.1, an elongation of the γ-linolenic acid to the 20:3 fatty acid is to be expected. Respectively 0.2 mM arachidonic acid and eicosapentaenoic acid were added in each case to the yeast culture transformed with pOTE2.1 and pOTE2.2. Corresponding to the activity of OtELO2.1, it is to be expected that the fatty acids ARA and EPA will be elongated respectively to the 22:4 and 22:5 fatty acids. Expression was induced by adding 2% (w/v) galactose. The cultures were incubated at 20° C. for a further 96 h.

Example 6

Expression of OtELO2.2 (as Depicted in SEQ ID NO: 64) and OtELO1.2 (as in SEQ ID NO: 122) in Yeasts Yeasts transformed as in example 5 with the plasmids pYES2, pOTE1.2 and pOTE2.1 were analyzed in the following way:

The yeast cells from the main cultures were harvested by centrifugation (100×g, 5 min, 20° C.) and washed with 100 mM NaHCO$_3$, pH 8.0, in order to remove remaining medium and fatty acids. Fatty acid methyl esters (FAMES) were prepared from the yeast cell sediments by acidic methanolysis. For this purpose, the cell sediments were incubated with 2 ml of 1 N methanolic sulfuric acid and 2% (v/v) dimethoxypropane at 80° C. for 1 h. The FAMES were extracted by extraction twice with petroleum ether (PE). To remove underivatized fatty acids, the organic phases were washed once each with 2 ml of 100 mM NaHCO$_3$, pH 8.0 and with 2 ml of distilled water. The PE phases were then dried with Na$_2$SO$_4$, evaporated under argon and taken up in 100 μl of PE. The samples were separated on a DB-23 capillary column (30 m, 0.25 mm, 0.25 μm, Agilent) in a Hewlett-Packard 6850 gas chromatograph with flame ionization detector. The conditions for the GLC analysis were as follows: the oven temperature was programmed from 50° C. to 250° C. at a rate of 5° C./min and finally 10 min at 250° C. (holding).

The signals were identified by comparing the retention times with appropriate fatty acid standards (Sigma). The methodology is described for example in Napier and Michaelson (2001) Lipids 36(8): 761-766; Sayanova et al. (2001) Journal of Experimental Botany 52(360): 1581-1585, Sperling et al. (2001) Arch. Biochem. Biophys. 388(2): 293-298 and Michaelson et al. (1998) FEBS Letters 439(3): 215-218. The results of the analyses are depicted in table 1.

It was possible to confirm the appropriate activities both for pOTE1.1/pOTE1.2 and for pOTE2.1/2.2. The optimized sequence (respectively pOTE1.2 and pOTE2.2) showed activity in both cases. Synthesis of γ-linolenic acid could be increased only slightly by pOTE1.2 compared with the wild-type sequence. By contrast, it was possible to observe for pOTE2.2 surprisingly both an increase in the activity and an alteration in the specificity (table 1). In this connection, the activity for elongation of EPA had virtually doubled, while the elongation of ARA had more than quadrupled. It was thus possible with the optimization of the sequence of the Δ5-elongase from *Ostreococcus tauri* to increase the yield of the precursors of DHA 6-fold in yeast with the same amount of substrate.

Example 7

Cloning Expression Plasmids for the Seed-Specific Expression in Plants

The following general conditins described apply to all subsequent experiments unless described otherwise.

pBin19, pBI101, pBinAR, pGPTV, pCAMBIA or pSUN are preferably used for the following examples in accordance with the invention. An overview of the binary vectors and their use can be found in Hellens et al, Trends in Plant Science (2000) δ: 446-451. A pGPTV derivative as described in DE10205607 was used. This vector differs from pGPTV by an additionally inserted AscI restriction cleavage site.

Starting point of the cloning procedure was the cloning vector pUC19 (Maniatis et al.). In the first step, the conlinin promoter fragment was amplified using the following primers:

```
Cnl1 C 5':
gaattcggcgcgccgagctcctcgagcaacggttccggcggtatagagtt
gggtaattcga

Cnl1 C 3':
cccgggatcgatgccggcagatctccaccattttttggtggtgat
```

Composition of the PCR Mix (50 µl):
5.00 µl template cDNA
5.00 µl 10× buffer (Advantage polymerase)+25 mM $MgCl_2$
5.00 µl of 2 mM dNTP
1.25 µl of each primer (10 pmol/µl)
0.50 µl of Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was first incubated for 2 hours at 37° C. with the restriction enzyme EcoRI and then for 12 hours at 25° C. with the restriction enzyme SmaI. The cloning vector pUC19 was incubated in the same manner. Thereafter, the PCR product and the 2668 bp cleaved vector were separated by agarose gel electrophoresis and the corresponding DNA fragments were excised. The DNA was purified by means of the Qiagen Gel Purification Kit following the manufacturer's instructions. Thereafter, vector and PCR product were ligated. The Rapid Ligation Kit from Roche was used for this purpose. The resulting plasmid pUC19-Cnl1-C was verified by sequencing.

In the next step, the OCS terminator (Genbank Accession V00088; De Greve, H., et al. (1982) J. Mol. Appl. Genet. 1 (6): 499-511) was amplified from the vector pGPVT-USP/OCS (DE 102 05 607) using the following primers:

```
OCS_C 5':  aggcctccatggcctgctttaatgagatatgcgagacgcc

OCS_C 3':  cccgggccggacaatcagtaaattgaacggag
```

Composition of the PCR Mix (50 µl):
5.00 µl template cDNA
5.00 µl 10× buffer (Advantage polymerase)+25 mM $MgCl_2$
5.00 µl of 2 mM dNTP
1.25 µl of each primer (10 pmol/µl)
0.50 µl of Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was first incubated for 2 hours at 37° C. with the restriction enzyme StuI and then for 12 hours at 25° C. with the restriction enzyme SmaI. The vector pUC19-Cnl1-C was incubated for 12 hours at 25° C. with the restriction enzyme SmaI. Thereafter, the PCR product and the cleaved vector were separated by agarose gel electrophoresis and the corresponding DNA fragments were excised. The DNA was purified by means of the Qiagen Gel Purification Kit following the manufacturer's instructions. Thereafter, vector and PCR product were ligated. The Rapid Ligation Kit from Roche was used for this purpose. The resulting plasmid pUC19-Cnl1-C_OCS was verified by sequencing.

In the next step, the Cnl1-B promoter was amplified by PCR by means of the following primers:

```
Cnl1-B 5':
aggcctcaacggttccggcggtatag

Cnl1-B 3':
cccgggttaacgctagcgggcccgatatcggatcccatttttggtggt
gattggttct
```

Composition of the PCR Mix (50 µl):
5.00 µl template cDNA
5.00 µl 10× buffer (Advantage polymerase)+25 mM $MgCl_2$
5.00 µl of 2 mM dNTP
1.25 µl of each primer (10 pmol/µl)
0.50 µl of Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was first incubated for 2 hours at 37° C. with the restriction enzyme StuI and then for 12 hours at 25° C. with the restriction enzyme SmaI. The vector pUC19-Cnl1-C was incubated for 12 hours at 25° C. with the restriction enzyme SmaI. Thereafter, the PCR product and the cleaved vector were separated by agarose gel electrophoresis and the corresponding DNA fragments were excised. The DNA was purified by means of the Qiagen Gel Purification Kit following the manufacturer's instructions. Thereafter, vector and PCR product were ligated. The Rapid Ligation Kit from Roche was used for this purpose. The resulting plasmid pUC19-Cnl1-C_Cnl1B_OCS was verified by sequencing.

In a further step, the OCS terminator for Cnl1B was inserted. To this end, the PCR was carried out using the following primers:

```
OCS2 5':     aggcctcctgctttaatgagatatgcgagac

OCS2 3':     cccgggcggacaatcagtaaattgaacggag
```

Composition of the PCR Mix (50 µl):
5.00 µl template cDNA
5.00 µl 10× buffer (Advantage polymerase)+25 mM MgCl$_2$
5.00 of 2 mM dNTP
1.25 µl of each primer (10 pmol/µl)
0.50 µl of Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was first incubated for 2 hours at 37° C. with the restriction enzyme StuI and then for 12 hours at 25° C. with the restriction enzyme SmaI. The vector pUC19-Cnl1C_Cnl1B_OCS was incubated for 12 hours at 25° C. with the restriction enzyme SmaI. Thereafter, the PCR product and cleaved vector were separated by agarose gel electrophoresis and the corresponding DNA fragments were excised. The DNA was purified by means of the Qiagen Gel Purification Kit following the manufacturer's instructions. Thereafter, vector and PCR product were ligated. The Rapid Ligation Kit from Roche was used for this purpose. The resulting plasmid pUC19-Cnl1-C_Cnl1B_OCS2 was verified by sequencing.

In the next step, the Cnl1-A promoter is amplified by PCR using the following primers:

```
Cnl1-B 5':
aggcctcaacggttccggcggtatagag

Cnl1-B 3':
aggccttctagactgcaggcggccgcccgcattttttggtggtgattggt
```

Composition of the PCR Mix (50 µl):
5.00 µl template cDNA
5.00 µl 10× buffer (Advantage polymerase)+25 mM MgCl$_2$
5.00 µl of 2 mM dNTP
1.25 µl of each primer (10 pmol/µl)
0.50 µl of Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was incubated for 2 hours at 37° C. with the restriction enzyme StuI. The vector pUC19-Cnl1-C was incubated for 12 hours at 25° C. with the restriction enzyme SmaI. Thereafter, the PCR product and cleaved vector were separated by agarose gel electrophoresis and the corresponding DNA fragments were excised. The DNA was purified by means of the Qiagen Gel Purification Kit following the manufacturer's instructions. Thereafter, vector and PCR product were ligated. The Rapid Ligation Kit from Roche was used for this purpose. The resulting plasmid pUC19-Cnl1C_Cnl1B_Cnl1A_OCS2 was verified by sequencing.

In a further step, the OCS terminator for Cnl1A was inserted. To this end, the PCR was carried out with the following primers:

```
OCS2 5':
ggcctcctgctttaatgagatatgcga

OCS2 3':
aagcttggcgcgccgagctcgtcgacggacaatcagtaaattgaacggaga
```

Composition of the PCR Mix (50 µl):
5.00 µl template cDNA
5.00 µl 10× buffer (Advantage polymerase)+25 mM MgCl$_2$
5.00 µl of 2 mM dNTP
1.25 µl of each primer (10 pmol/µl)
0.50 µl of Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was first incubated for 2 hours at 37° C. with the restriction enzyme StuI and then for 2 hours at 37° C. with the restriction enzyme HindIII. The vector pUC19-Cnl1C_Cnl1B_Cnl1A_OCS2 was incubated for 2 hours at 37° C. with the restriction enzyme StuI and for 2 hours at 37° C. with the restriction enzyme HindIII. Thereafter, the PCR product and cleaved vector were separated by agarose gel electrophoresis and the corresponding DNA fragments were excised. The DNA was purified by means of the Qiagen Gel Purification Kit following the manufacturer's instructions. Thereafter, vector and PCR product were ligated. The Rapid Ligation Kit from Roche was used for this purpose. The resulting plasmid pUC19-Cnl1-C_Cnl1B_Cnl1A_OCS3 was verified by sequencing.

In the next step, the plasmid pUC19-Cnl1C_Cnl1B_Cnl1A_OCS3 was used for cloning the Δ6-, Δ5-desaturase and Δ6-elongase. To this end, the *Phytium irregulare* Δ6-desaturase (WO02/26946) was amplified using the following PCR primers:

```
D6Des(Pir) 5': agatctatggtggacctcaagcctggagtg

D6Des(Pir) 3': ccatggcccggggttacatcgctgggaactcggtgat
```

Composition of the PCR Mix (50 µl):
5.00 µl template cDNA
5.00 µl 10× buffer (Advantage polymerase)+25 mM MgCl$_2$
5.00 µl of 2 mM dNTP
1.25 µl of each primer (10 pmol/µl)
0.50 µl of Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was first incubated for 2 hours at 37° C. with the restriction enzyme BglII and then for 2 hours at 37° C. with the restriction enzyme NcoI. The vector pUC19-Cnl1C_Cnl1B_Cnl1A_OCS3 was incubated for 2 hours at 37° C. with the restriction enzyme BglII and for 2 hours at 37° C. with the restriction enzyme NcoI. Thereafter, the PCR product and cleaved vector were separated by agarose gel electrophoresis and the corresponding DNA fragments were excised. The DNA was purified by means of the Qiagen Gel Purification Kit following the manufacturer's instructions. Thereafter, vector and PCR product were ligated. The Rapid Ligation Kit from Roche was used for this purpose. The resulting plasmid pUC19-Cnl1_d6Des(Pir) was verified by sequencing.

In the next step, the plasmid pUC19-Cnl1_d6Des(Pir) was used for cloning the *Thraustochytrium* ssp. Δ5-desaturase (WO02/26946). To this end, the *Thraustochytrium* ssp. Δ5-desaturase was amplified using the following PCR primers:

```
D5Des(Tc) 5':  gggatccatgggcaagggcagcgagggccg

D5Des(Tc) 3':  ggcgccgacaccaagaagcaggactgagatatc
```

Composition of the PCR Mix (50 μl):
5.00 μl template cDNA
5.00 μl 10× buffer (Advantage polymerase)+25 mM MgCl$_2$
5.00 μl of 2 mM dNTP
1.25 μl of each primer (10 pmol/μl)
0.50 μl of Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was first incubated for 2 hours at 37° C. with the restriction enzyme BamHI and then for 2 hours at 37° C. with the restriction enzyme EcoRV. The vector pUC19-Cnl1_d6Des(Pir) was incubated for 2 hours at 37° C. with the restriction enzyme BamHI and for 2 hours at 37° C. with the restriction enzyme EcoRV. Thereafter, the PCR product and cleaved vector were separated by agarose gel electrophoresis and the corresponding DNA fragments were excised. The DNA was purified by means of the Qiagen Gel Purification Kit following the manufacturer's instructions. Thereafter, vector and PCR product were ligated.

The Rapid Ligation Kit from Roche was used for this purpose. The resulting plasmid pUC19-Cnl1_d6Des(Pir) d5Des(Tc) was verified by sequencing.

In the next step, the plasmid pUC19-Cnl1_d6Des(Pir)_d5Des(Tc) was used for cloning the *Physcomitrella patens* Δ6-elongase (WO01/59128), for which purpose the latter was amplified using the following PCR primers:

```
D6Elo(Pp) 5':gcggccgcatggaggtcgtggagagattctacggtg

D6Elo(Pp) 3':gcaaaagggagctaaaactgagtgatctaga
```

Composition of the PCR Mix (50 μl):
5.00 μl template cDNA
5.00 μl 10× buffer (Advantage polymerase)+25 mM MgCl$_2$
5.00 μl of 2 mM dNTP
1.25 μl of each primer (10 pmol/μl)
0.50 μl of Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was first incubated for 2 hours at 37° C. with the restriction enzyme NotI and then for 2 hours at 37° C. with the restriction enzyme XbaI. The vector pUC19-Cnl1_d6Des(Pir)_d5Des(Tc) was incubated for 2 hours at 37° C. with the restriction enzyme NotI and for 2 hours at 37° C. with the restriction enzyme XbaI. Thereafter, the PCR product and cleaved vector were separated by agarose gel electrophoresis and the corresponding DNA fragments were excised. The DNA was purified by means of the Qiagen Gel Purification Kit following the manufacturer's instructions. Thereafter, vector and PCR product were ligated. The Rapid Ligation Kit from Roche was used for this purpose. The resulting plasmid pUC19-Cnl1_d6Des(Pir)_d5Des(Tc)_D6Elo(Pp) was verified by sequencing.

The binary vector for the transformation of plants was prepared starting from pUC19-Cnl1_d6Des(Pir)_d5Des (Tc)_ D6Elo(Pp). To this end, pUC19-Cnl1_d6Des(Pir)_d5Des(Tc)_D6Elo(Pp) was incubated for 2 hours at 37° C. with the restriction enzyme AscI. The vector pGPTV was treated in the same manner. Thereafter, the fragment from pUC19-Cnl1_d6Des(Pir)_d5Des(Tc)_D6Elo(Pp) and the cleaved pGPTV vector were separated by agarose gel electrophoresis and the corresponding DNA fragments were excised. The DNA was purified by means of Qiagen Gel Purification Kit following the manufacturer's instructions. Thereafter, vector and PCR product were ligated. The Rapid Ligation Kit from Roche was used for this purpose. The resulting plasmid pGPTV-Cnl1_d6Des(Pir)_d5Des(Tc)_D6Elo(Pp) was verified by sequencing.

A further construct, pGPTV-Cnl1_d6Des(Pir)_d5Des (Tc)_ D6Elo(Pp)_D12Des(Co), was used. To this end, the amplification was carried out with the following primers, starting from pUC19-Cnl1C_OCS:

```
Cnl1_OCS 5':   gtcgatcaacggttccggcggtatagagttg

Cnl1_OCS 3':   gtcgatcggacaatcagtaaattgaacggaga
```

Composition of the PCR Mix (50 μl):
5.00 μl template cDNA
5.00 μl 10× buffer (Advantage polymerase)+25 mM MgCl$_2$
5.00 μl of 2 mM dNTP
1.25 μl of each primer (10 pmol/μl)
0.50 μl of Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was incubated for 2 hours at 37° C. with the restriction enzyme SalI. The vector pUC19 was incubated for 2 hours at 37° C. with the restriction enzyme SalI. Thereafter, the PCR product and the cleaved vector were separated by agarose gel electrophoresis and the corresponding DNA fragments were excised. The DNA was purified by means of Qiagen Gel Purification Kit following the manufacturer's instructions. Thereafter, vector and PCR product were ligated. The Rapid Ligation Kit from Roche was used for this purpose. The resulting plasmid pUC19-Cnl1_OCS was verified by sequencing.

In a further step, the *Calendula officinalis* Δ12-desaturase gene (WO01/85968) was cloned into pUC19-Cnl1_OCS. To this end, d12Des(Co) was amplified with the following primers:

```
D12Des(Co) 5':   agatctatgggtgcaggcggtcgaatgc

D12Des(Co) 3':   ccatggttaaatcttattacgatacc
```

Composition of the PCR Mix (50 μl):
5.00 μl template cDNA
5.00 ml 10× buffer (Advantage polymerase)+25 mM MgCl$_2$
5.00 μl of 2 mM dNTP
1.25 μl of each primer (10 pmol/μl)
0.50 μl of Advantage polymerase (Clontech)

PCR Reaction Conditions:
Annealing temperature: 1 min 55° C.
Denaturation temperature: 1 min 94° C.
Elongation temperature: 2 min 72° C.
Number of cycles: 35

The PCR product was incubated for 2 hours at 37° C. with the restriction enzyme BglII and thereafter for 2 hours at the same temperature with NcoI. The vector pUC19-Cnl1_OCS was incubated in the same manner. Thereafter, the PCR fragment and the cleaved vector were separated by agarose gel electrophoresis and the corresponding DNA fragments were excised. The DNA was purified by means of Qiagen Gel Purification Kit following the manufacturer's instructions. Thereafter, vector and PCR product were ligated. The Rapid Ligation Kit from Roche was used for this purpose. The resulting plasmid pUC19-Cnl1_D12Des(Co) was verified by sequencing.

The plasmid pUC19-Cnl1_D12Des(Co) and the plasmid pUC19-Cnl1_d6Des(Pir)_d5Des(Tc)_D6Elo(Pp) were incubated for 2 hours at 37° C. with the restriction enzyme SalI. Thereafter, the vector fragment and the cleaved vector were separated by agarose gel electrophoresis and the corresponding DNA fragments were excised. The DNA was purified by means of Qiagen Gel Purification Kit following the manufacturer's instructions. Thereafter, vector and vector fragment were ligated. The Rapid Ligation Kit from Roche was used for this purpose. The resulting plasmid pUC19-Cnl1_d6Des(Pir)_d5Des(Tc)_D6Elo(Pp)_D12Des(Co) was verified by sequencing.

The binary vector for the transformation of plants was prepared starting from pUC19-Cnl1_d6Des(Pir)_d5Des(Tc)_ D6Elo(Pp)_D12Des(Co). To this end, pUC19-Cnl1_d6Des(Pir)_d5Des(Tc)_D6Elo(Pp)_D12Des(Co) was incubated for 2 hours at 37° C. with the restriction enzyme AscI. The vector pGPTV was treated in the same manner. Thereafter, the fragment from pUC19-Cnl1_d6Des(Pir)_d5Des(Tc)_D6Elo(Pp)_D12Des(Co) and the cleaved pGPTV vector were separated by agarose gel electrophoresis and the corresponding DNA fragments were excised. The DNA was purified by means of Qiagen Gel Purification Kit following the manufacturer's instructions. Thereafter, vector and PCR product were ligated. The Rapid Ligation Kit from Roche was used for this purpose. The resulting plasmid pGPTV-Cnl1_d6Des(Pir)_d5Des(Tc)_D6Elo(Pp)_D12Des(Co) was verified by sequencing.

A further example of the use of seed-specific expression constructs is the Napin promoter. Preparation of these Expression Constructs in the Vectors pGPTV or pSUN is Described in Wu et al. (2005) Nat. Biotech. 23:1013-1017.

A further vector suitable for plant transformation is pSUN2. This vector was used in combination with the Gateway system (Invitrogen, Karlsruhe) in order to increase the number of expression cassettes present in the vector to more than four. For this purpose, the Gateway cassette A was inserted into the vector pSUN2 in accordance with the manufacturer's instructions, as described below:

The pSUN2 vector (1 µg) was incubated with the restriction enzyme EcoRV at 37° for 1 h. The Gateway cassette A (Invitrogen, Karlsruhe) was then ligated into the cut vector using the Rapid Ligation kit from Roche, Mannheim. The resulting plasmid was transformed into E. coli DB3.1 cells (Invitrogen). The isolated plasmid pSUN-GW was then verified by sequencing.

In the second step, the expression cassette was cut out of pUC19-Cnl1_d6Des(Pir)_d5Des(Tc)_D6Elo(Pp)_D12Des (Co) using AscI and ligated into the likewise treated vector pSUN-GW. The plasmid obtained in this way pSUN-4G was used for further gene constructs.

For this purpose, firstly a pENTR clone was modified in accordance with the manufacturer's instructions (Invitrogen). The plasmid pENTR1A (Invitrogen) was incubated with the restriction enzyme EcoRI at 37° for 1 h and then treated with Klenow enzyme and with a 1 µM dNTP mix for 30 min, and subsequently the AscI adapter (5'-ggcgcgcc; phosphorylated at the 5' end, double-stranded) was ligated into the pENTR1A vector. Genes were inserted as described above stepwise into the Cn1 cassette in these modified and transferred via AscI into the pENTR vector, resulting in the pENTR-Cn1 vector.

In a further step, the pSUN-8G construct was prepared. For this purpose, 5' and 3' primers for the genes with the SEQ ID NOs: 1, 3, 5 and 7 with the restriction cleavage sites described above and with the first and in each case last 20 nucleotides of the open reading frame were produced and amplified with the standard conditions (see above) and ligated into the pENTR-Cn1 vector, which was subsequently subjected to a recombination reaction with the pSUN-4G vector in accordance with the manufacturer's instructions.

The construct pSUN-8G was prepared in this way and was transformed into Brassica juncea and Brassica napus. The seeds of the transgenic plants were analyzed by gas chromatography.

A further construct which was used for transformation of B. juncea and B. napus was the construct pSUN-9G. This construct was prepared according to Wu et al. (2005) Nat. Biotech. 23:1013-1017 with the napin promoter. In a modification of Wu et al. 2005, the coding sequence of OtELO2.2 was inserted in the described manner instead of the gene OmELO. The resulting construct pSUN-9G was then transformed into B. juncea and B. napus.

Example 8

Lipid Extraction from Plant Material

The effect of the genetic modification in plants on the production of a desired compound (such as a fatty acid) can be determined by growing the modified plant under suitable conditions (such as those described above) and analyzing the medium and/or the cellular components for the elevated production of the desired product (i.e. of the lipids or a fatty acid). These analytical techniques are known to the skilled worker and comprise spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, p. 89-90 and p. 443-613, VCH: Weinheim (1985); Fallon A. et al. (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", p. 469-714, VCH: Weinheim; Better, P. A. et al. (1988) Bioseparations: downstream processing for Biotechnology, John Wiley and Sons; Kennedy, J. F., and Cabral, J. M. S. (1992) Recovery processes for biological Materials, John Wiley and Sons; Shaeiwitz, J. A., and Henry, J. D. (1988) Biochemical Separations, in: Ullmann's Encyclopedia of Industrial Chemistry, Vol. B3; Chapter 11, p. 1-27, VCH: Weinheim; and Dechow, F. J. (1989) Separation and purification techniques in biotechnology, Noyes Publications).

In addition to the abovementioned methods, plant lipids are extracted from plant material as described by Cahoon et al. (1999) Proc. Natl. Acad. Sci. USA 96 (22):12935-12940 and Browse et al. (1986) Analytic Biochemistry 152:141-145. The qualitative and quantitative analysis of lipids or fatty acids is described by Christie, William W., Advances in Lipid Methodology, Ayr/Scotland: Oily Press (Oily Press Lipid Library; 2); Christie, William W., Gas Chromatography and Lipids. A Practical Guide—Ayr, Scotland: Oily Press, 1989, Repr. 1992, IX, 307 pp. (Oily Press Lipid Library; 1); "Progress in Lipid Research, Oxford: Pergamon Press, 1 (1952)-16 (1977) under the title: Progress in the Chemistry of Fats and Other Lipids CODEN.

In addition to measuring the end product of the fermentation, it is also possible to analyze other components of the metabolic pathways which are used for the production of the desired compound, such as intermediates and by-products, in order to determine the overall production efficiency of the compound. The analytical methods comprise measuring the amount of nutrients in the medium (for example sugars, hydrocarbons, nitrogen sources, phosphate and other ions), measuring the biomass composition and the growth, analyzing the production of conventional metabolites of biosynthetic pathways and measuring gases which are generated during the fermentation. Standard methods for these measurements are described in Applied Microbial Physiology; A Practical Approach, P. M. Rhodes and P. F. Stanbury, Ed., IRL Press, p. 103-129; 131-163 and 165-192 (ISBN: 0199635773) and references cited therein.

One example is the analysis of fatty acids (abbreviations: FAME, fatty acid methyl ester; GC-MS, gas liquid chromatography/mass spectrometry; TAG, triacylglycerol; TLC, thin-layer chromatography).

The unambiguous detection for the presence of fatty acid products can be obtained by analyzing recombinant organisms using analytical standard methods: GC, GC-MS or TLC, as described on several occasions by Christie and the references therein (1997, in: Advances on Lipid Methodology, Fourth Edition: Christie, Oily Press, Dundee, 119-169; 1998, Gaschromatographie-Massenspektrometrie-Verfahren [Gas chromatography/mass spectrometric methods], Lipide 33:343-353).

The material to be analyzed can be disrupted by sonication, grinding in a glass mill, liquid nitrogen and grinding or via other applicable methods. After disruption, the material must be centrifuged. The sediment is resuspended in distilled water, heated for 10 minutes at 100° C., cooled on ice and recentrifuged, followed by extraction for one hour at 90° C. in 0.5 M sulfuric acid in methanol with 2% dimethoxypropane, which leads to hydrolyzed oil and lipid compounds, which give transmethylated lipids. These fatty acid methyl esters are extracted in petroleum ether and finally subjected to a GC analysis using a capillary column (Chrompack, WCOT Fused Silica, CP-Wax-52 CB, 25 m, 0.32 mm) at a temperature gradient of between 170° C. and 240° C. for 20 minutes and 5 minutes at 240° C. The identity of the resulting fatty acid methyl esters must be defined using standards which are available from commercial sources (i.e. Sigma).

Plant material is initially homogenized mechanically by comminuting in a pestle and mortar to make it more amenable to extraction.

This is followed by heating at 100° C. for 10 minutes and, after cooling on ice, by resedimentation. The cell sediment is hydrolyzed for one hour at 90° C. with 1 M methanolic sulfuric acid and 2% dimethoxypropane, and the lipids are transmethylated. The resulting fatty acid methyl esters (FAMEs) are extracted in petroleum ether. The extracted FAMEs are analyzed by gas liquid chromatography using a capillary column (Chrompack, WCOT Fused Silica, CP-Wax-52 CB, 25 m, 0.32 mm) and a temperature gradient of from 170° C. to 240° C. in 20 minutes and 5 minutes at 240° C. The identity of the fatty acid methyl esters is confirmed by comparison with corresponding FAME standards (Sigma). The identity and position of the double bond can be analyzed further by suitable chemical derivatization of the FAME mixtures, for example to give 4,4-dimethoxyazolin derivatives (Christie, 1998) by means of GC-MS.

Example 9

Use of the Optimized M-Elongase (as Depicted in SEQ ID NO: 64) from *Ostreococcus tauri* for Constructs for Constitutive Expression Transformation vectors based on pGPTV-35S, a plasmid based on pBIN19-35S (Bevan M. (1984) Nucl. Acids Res. 18:203), were produced for the transformation of plants. For this purpose, firstly an expression cassette consisting of the promoter element CaMV35S (SEQ ID NO: 161) and the 35S terminator (SEQ ID NO: 162; Franck, A. et al. (1980) Cell 21 (1): 285-294) was assembled in a pUC vector. This entailed the promoter being inserted via the SalI/XbaI restriction cleavage sites and the terminator via the BamHI/SmaI restriction cleavage sites. In addition, a polylinker with the XhoI cleavage site was attached to the terminator ('triple ligation'). The resulting plasmid pUC19-35S was then employed for cloning PUFA genes. In parallel, the open reading frames of the Δ6-desaturase (SEQ ID NO: 1), of the Δ5-desaturase (SEQ ID NO: 51) and Δ6-elongase (SEQ ID NO: 171) sequences were inserted via the EcoRV cleavage site into pUC19-35S vectors. The resulting plasmids pUC-D6, pUC-D5, pUC-E6(Tc) were used to construct the binary vector pGPTV-35S_D6D5E6(Tc). For this purpose, the vector pGPTV was digested with the enzyme SalI, the plasmid pUC-D6 was digested with SalI/XhoI, and the correct fragments were ligated. The resulting plasmid pGPTV-D6 was then digested with SalI, the plasmid pUC-D5 was digested with SalI/XhoI, and the correct fragments were ligated. The resulting plasmid pGPTV-D6-D5 was then digested once more with SalI, the plasmid pUC-E6(Tc) with SalI/XhoI, and the correct fragments were ligated. These sequential cloning steps resulted in the binary vector pGPTV-D6D5E6 (Tc), which was employed for the transformation.

In a further procedure, the sequence of d6Elo(Tp) (SEQ ID NO: 163) was inserted into the vector pUC19-35S instead of the sequence d6Elo(Tc). The resulting plasmid pUC-E6(Tp) was used to prepare the binary vector pGPTV-35S_D6D5E6(Tp).

In a further procedure, the open reading frame of ω3Des (SEQ ID NO: 193) was cloned into pUC19-35S. The resulting plasmid pUC-ω3Pi was transferred via SalI/XhoI into the binary vectors pGPTV-D6D5E6(Tc) and pGPTV-D6D5E6(Tp). The resulting vectors pGPTV-D6D5E6(Tc) ω3Pi and pGPTV-D6D5E6(Tp)ω3Pi were employed for the plant transformation.

In a further procedure, the open reading frame of the optimized Δ5-elongase from *Ostreococcus tauri* (SEQ ID NO: 64) and the open reading frame of the Δ4-desaturase from *Thraustochytrium* sp. (SEQ ID NO: 77) was cloned into pUC19-35S. The resulting plasmids pUC-E5 and pUC-D4 were then transferred via SalI/XhoI in accordance with the above statements into the vector pGPTV-D6D5E6(Tp) ω3Pi. The resulting vector pGPTV-D6D5E6(Tp)ω3PiE5D4 was employed for the plant transformation.

All the binary vectors were transformed into *E. coli* DH5α cells (Invitrogen) in accordance with the manufacturer's instructions. Positive clones were identified by PCR, and plasmid DNA was isolated (Qiagen Dneasy).

Example 10

Transformation of the Constitutive Binary Vectors into Plants a) Generation of Transgenic *Brassica napus* and *Brassica juncea* Plants. The Protocol for the Transformation of Oilseed Rape Plant was Used (Modification of Moloney et al. (1992) Plant Cell Reports 8:238-242)

The binary vector pGPTV-D6D5E6(Tp)ω3PiE5D4 was transformed in *Agrobacterium tumefaciens* C58C1: pGV2260 (Deblaere et al. (1984) Nucl. Acids. Res. 13: 4777-4788). A 1:50 dilution of an overnight culture of a positively transformed agrobacterial colony in Murashige-Skoog medium (Murashige and Skoog (1962) Physiol. Plant. 15: 473) supplemented with 3% sucrose (3MS medium) was used for the transformation of *Orychophragmus violaceus*. Petioles or hypocotyls of freshly germinated sterile plants (in each case approx. 1 cm²) were incubated with a 1:50 agrobacterial dilution for 5-10 minutes in a Petri dish. This is followed by 3 days of coincubation in the dark at 25° C. on 3MS medium supplemented with 0.8% Bacto agar. Thereafter, the cultivation was continued with 16 hours light/8 hours dark and a weekly rhythm on MS medium supplemented with 500 mg/l Claforan (cefotaxime-sodium), 50 mg/l kanamycin, 20 µM benzylaminopurine (BAP) and 1.6 g/l glucose. Growing shoots were transferred to MS medium supplemented with 2% sucrose, 250 mg/l Claforan and 0.8% Bacto agar. If no roots had developed after three weeks, 2-indolebutyric acid was added to the medium as growth hormone for rooting.

Regenerated shoots were obtained on 2MS medium with kanamycin and Claforan, then, after rooting, transferred into soil and, after cultivation, grown for two weeks in a controlled-environment cabinet or in the greenhouse, allowed to flower, mature seeds were harvested and analyzed for elongase expression such as Δ6-elongase activity or for Δ5- or Δ6-desaturase activity by means of lipid analyses. In this manner, lines with elevated contents of polyunsaturated C20- and C22-fatty acids were identified.

b) Generation of Transgenic *Orychophragmus violaceus* Plants

The protocol for the transformation of oilseed rape plants was used (modification of Moloney et al. (1992) Plant Cell Reports 8:238-242) as described under a).

To generate transgenic plants, the binary vector pGPTV-D6D5E6(Tp)ω3PiE5D4 was transformed into *Agrobacterium tumefaciens* C58C1:pGV2260 (Deblaere et al. (1984) Nucl. Acids. Res. 13: 4777-4788). A 1:50 dilution of an overnight culture of a positively transformed *Agrobacterium* colony in Murashige-Skoog medium (Murashige and Skoog (1962) Physiol. Plant, 15: 473) with 3% sucrose (3MS medium) was used to transform *Orychophragmus violaceus*. Petioles or hypocotyls of freshly germinated sterile plants (each about 1 cm²) were incubated with a 1:50 agrobacterial dilution in a Petri dish for 5-10 minutes. This is followed by coincubation on 3MS medium with 0.8% Bacto agar in the dark at 25° C. for 3 days. The cultivation was then continued with 16 hours light/8 hours dark and in a weekly rhythm on MS medium with 500 mg/l Claforan (cefotaxime sodium), 15 mg/l kanamycin, 20 µM benzylaminopurine (BAP) and 1.6 g/l glucose. Growing shoots were transferred to MS medium with 2% sucrose, 250 mg/l Claforan and 0.8% Bacto agar. If no roots had developed after three weeks, 2-indolebutyric acid was added to the medium as growth hormone for rooting.

Regenerated shoots were obtained on 2MS medium with kanamycin and Claforan and, after rooting, transferred to soil and, after cultivation, grown for two weeks in a controlled environment cabinet or in a greenhouse, allowed to flower, and mature seeds were harvested and examined by lipid analyses for elongase expression such as Δ-6-elongase activity or Δ-5- or Δ-6-desaturase activity. Lines with increased contents of polyunsaturated C20 and C22 fatty acids were identified in this way.

c) Transformation of *Arabidopsis thaliana* Plants

The protocol of Bechthold et al. (1993) C.R. Acad. Sci. Ser. III Sci. Vie. 316: 1194-1199 was used.

To generate transgenic plants, the generated binary vector pGPTV-D6D5E6(Tp)ω3PiE5D4 was transformed into *Agrobacterium tumefaciens* C58C1:pMP90 (Deblaere et al. (1984) Nucl. Acids. Res. 13: 4777-4788) and, in accordance with the protocol of Bechthold et al. (1993), flowers of *Arabidopsis thaliana* cv. Columbia 0 were dipped in an agrobacterial solution with OD600=1.0. The procedure was repeated again two days later. Seeds from these flowers were then placed on agar plates with ½ MS, 2% sucrose and 50 mg/l kanamycin. Green seedlings were then transferred to soil.

Example 11

Analysis of Plant Material of Transgenic *Orychophragmus* or *Arabidopsis* Plants Extraction of leaf material of transgenic *Orychophragmus violaceus* and *Arabidopsis thaliana* plants transformed with pGPTV-D6D5E6(Tp)ω3PiE5D4 and the gas chromatography analysis was carried out as described in example 8. Table 2 shows the results of the analyses. The various fatty acids are indicated in percent by weight. It was possible to show that long-chain polyunsaturated fatty acids were synthesized by both different plant species. It was surprisingly possible with the optimized sequence of the Δ5-elongase (as depicted in SEQ ID NO: 64) from *Ostreococcus tauri* to obtain a distinctly higher yield of DHA than reported for example by Robert et al. (2005) Functional Plant Biology 32: 473-479 for *Arabidopsis thaliana* with 1.5% DHA. It was possible for the first time to achieve a synthesis of long-chain polyunsaturated fatty acids for *Orychophragmus violaceus*.

Example 12

Analysis of Seeds of Transgenic *Brassica juncea* Lines

Extraction of seeds of transgenic *Brassica juncea* plants transformed with pSUN-9G, and the gas chromatography analysis was carried out as described in example 8. Table 6 shows the results of the analyses. The various fatty acids are indicated in percent area. As in Wu et al. 2005 it was possible to show the synthesis of long-chain polyunsaturated fatty acids (PUFA). Surprisingly, the use of the modified elongase sequence OtELO2.2 such as the nucleic acid sequence described by SEQ ID NO: 64 resulted in a drastic increase in the content of C22 fatty acids. In total, the seed oil contained about 8% by weight % polyunsaturated C22 fatty acids. Specifically, the content of the fatty acid docosahexaenoic acid (DHA) in the seed oil was 1.9% by weight %, representing an increase by a factor of 10 compared with Wu et al. 2005.

Example 13

Detailed Analysis of the Lipid Classes and Position Analysis of Leaf Material from *O. violaceus*

About 1 g of leaf tissue was heated in 4 ml of isopropanol at 95° C. for 10 minutes, homogenized by Polytron and shaken after addition of 1.5 ml of chloroform. The samples were centrifuged, the supernatant was collected, and the pellet was extracted again with isopropanol:chloroform 1:1 (v/v). The two extracts were combined, dried and dissolved in chloroform. The lipid extract was prefractionated on a silica prepsep column (Fisher Scientific, Nepean, Canada) into neutral lipids, glycolipids and phospholipids, eluting with chloroform:acetic acid 100:1 (v/v), acetone:acetic acid 100:1 (v/v) and methanol:chloroform:water 100:50:40 (v/v/v), respectively. These fractions were further fractionated on silica G-25 thin-layer chromatography plates (TLC; Macherey-Nagel, Düren, Germany). Neutral lipids were developed with hexane:diethyl ether:acetic acid (70:30:1), glycolipids with chloroform:methanol:ammonia (65:25:4 v/v/v) and phospholipids with chloroform:methanol:ammonia:water (70:30:4:1 v/v/v/v). The individual lipid classes were identified after spraying with primulin under UV light, removed by scraping off the plates and either used for direct transmethylation or extracted by a suitable solvent for further analysis.

It was possible by the disclosed methods for the various lipid classes (neutral lipids, phospholipids and galactolipids) to be fractionated and analyzed separately. The glycolipids were additionally examined for the position of the individual fatty acids.

a) Regiospecific Analysis of the Triacylglycerides (TAG)

Three to five mg of the TLC-purified TAG were dried under nitrogen in a glass tube, resuspended in aqueous buffer by brief ultrasound treatment (1 M Tris pH 8; 2.2% $CaCl_2$ (w/v); 0.05% bile salts (w/v)) and incubated at 40° C. for 4 minutes. After addition of 0.1 ml of a solution of pancreatic lipase (10 mg/ml in water), the samples were vigorously vortexed for 3 minutes, and the digestion was stopped by adding 1 ml of ethanol and 1.5 ml of 4 M HCl. The partly digested TAGs were extracted twice with diethyl ether, washed with water, dried and dissolved in a small volume of chloroform, Monoacylglycerols (MAG) were separated from the free fatty acids and undigested TAGs on a TLC plate as described above for neutral lipids. The point corresponding to the MAGs was analyzed by GC and represented the sn-2 position of the TAGs. The distribution of the fatty acids to the remaining sn-1 and sn-3 positions was calculated by the following formula: sn-1 sn-3=(TAG×3−MAG)/2.

This position analysis of the triacylglycerides revealed in this case that EPA and DHA are present in similar concentrations in the sn-2 and sn-1/3 positions, while ARA is to be found overall only in small amounts in the triacylglycerides, and here mainly in the sn-2 position (Tab. 3).

b) Stereospecific Analysis of Phospholipids

Fractionated and extracted phosphatidylglycol (PG), phosphatidylethanolamine (PE) and phosphatidylcholine (PC) were dried under $N_2$ and resuspended in 0.5 ml of borate buffer (0.5M, pH 7.5, containing 0.4 mM $CaCl_2$). After a brief ultrasound treatment, 5U of phospholipase Δ2 from the venom of *Naja mossambica* (Sigma P-7778) and 2 ml of diethyl ether were added and the samples were vortexed at room temperature for 2 hours. The ether phase was dried, the digestion was stopped with 0.3 ml of 1M HCl, and the reaction mixture was extracted with chloroform:methanol (2:1 v/v). The digested phospholipids were separated by TLC in chloroform:methanol:ammonia:water (70:30:4:2 v/v/v/v) and points which corresponded to the liberated free fatty acids and lysophospholipids were removed by scraping and directly transmethylated.

Positional analysis of the phospholipids showed an accumulation of EPA and DHA in the sn-2 position of phosphatidylcholine (PC), while DHA was similarly distributed in sn-1 and sn-2 position in phosphatidylethanolamine (PE). Only traces of, or no, ARA was to be found in both phospholipids (Tab. 4). The concentrations of EPA and DHA in phosphatidylglycerol were lower than in the other investigated phospholipids, with accumulation in the sn-2 position also to be observed in this lipid class (Tab. 4, PG).

c) Stereospecific Analysis of Glycolipids

The galactolipids were investigated as a further polar lipid class. Galactolipids are found in the membranes of plastids and form the main components there.

TLC-purified monogalactosyldiacylglycerol (MGDG) and digalactosyldiacylglycerol (DGDG) were dried under nitrogen and dissolved in 0.5 ml of diethyl ether. Then 25 units of the lipase from *Rhizopus arrhizus* (Sigma 62305), resuspended in 2 ml of borate buffer (50 mM, pH 7.5 containing 2 mM $CaCl_2$), were added, and the samples were vortexed at room temperature for 2 hours. The ether phase was dried and the digestion was stopped by adding 0.3 ml of 1M HCl, and the lipids were extracted with 4 ml of chloroform:methanol (2:1 v/v). After drying, the digested galactolipids were in a small volume of chloroform:methanol (2:1 v/v) and developed twice on a precoated silica TLC plate, firstly with chloroform:methanol:ammonia:water (70:30:4:1 v/v/v/v) to about two thirds the height of the plate, followed by complete development in hexane:diethyl ether:acetic acid (70:30:1). The points which corresponded to the liberated free fatty acids and the lysogalactolipids were identified after spraying with primulin, scraped off and transmethylated directly for GC analysis.

It was possible to find VLCPUFA in these lipids too, with an accumulation of EPA in the sn-2 position being observed. DHA was to be found only in the digalactodiacylglycerols (DGDG) and was undetectable in the monogalactodiacylglycerols (MGDG) (Table 5). The distribution of VLCPUFA in galactolipids, a compartment in which these fatty acids were not expected, shows the dynamics of the synthesis and the later transformation. VLCPUFA in polar lipids are of particular nutritional value because they can be absorbed better in the intestines of mammals than the neutral lipids.

TABLE 1

Test of the optimized sequences of pOTE1.1 and pOTE2.1 in yeast. The conversion rates were determined in accordance with the substrate conversions. A distinct rise in activity was achievable with the optimized sequence in plasmid pOTE2.2.
Conversion rates of the *Ostreococcus tauri* elongases

| | Genes | Substrate Product | GLA 20:3 | ARA 22:4 | EPA 22:5 |
|---|---|---|---|---|---|
| pOTE1.1 | d6Elongase(Ot) | | 21.1 | | |
| pOTE1.2 | d6Elongase(Ot)_opt | | 25.6 | | |
| pOTE2.1 | d5Elongase(Ot) | | | 7.3 | 35.9 |
| pOTE2.2 | d5Elongase(Ot)_opt | | | 32.7 | 63.1 |

TABLE 2

Gas chromatographic analysis of leaf material of *Orychophragmus violaceus* and *Arabidopsis thaliana*. The individual fatty acids are indicated in percent area.

| | Fatty acids | | | | | | | | | | |
|---|---|---|---|---|---|---|---|---|---|---|---|
| | 16:0 | 16:3 | 18:1 | 18:2 | GLA | 18:3 | 18:4 | ARA | EPA | DPA | DHA |
| Fatty acid composition of leaf material of *Orychophragmus violaceus* | | | | | | | | | | | |
| Control | 20.9 | 8.5 | 3.3 | 16.0 | 0.0 | 47.4 | 0.0 | 0.0 | 0.0 | 0.0 | 0.0 |
| Transgene | 21.3 | 8.2 | 5.2 | 5.2 | 4.2 | 23.1 | 5.0 | 0.6 | 13.5 | 2.7 | 4.5 |
| Fatty acid composition of leaf material of *Arabidopsis thaliana* | | | | | | | | | | | |
| Control | 12.8 | 10.0 | 3.5 | 14.2 | 0.0 | 54.6 | 0.0 | 0.0 | 0.0 | 0.0 | 0.0 |
| Transgene | 19.3 | 8.5 | 5.0 | 4.6 | 6.4 | 31.0 | 4.4 | 0.0 | 6.3 | 1.5 | 6.3 |

TABLE 3

Regiospecific analysis of the triacylglycerides from leaf material from transgenic *O. violaceus* plants.

| TAG | 16:0 | 18:0 | 18:1n-9 | 18:2n-9 | 18:2n-6 | 18:3n-6 | 18:3n-3 | 18:4n-3 | 20:3n-6 | 20:4n-6 | 20:4n-3 | 20:5n-3 | 22:6n-3 | 22:6n-3 |
|---|---|---|---|---|---|---|---|---|---|---|---|---|---|---|
| wt | 25.12 | 3.03 | 5.06 | | 18.53 | | 44.72 | | | | | | | |
| sn-2 | 1.42 | 0.76 | 6.79 | | 27.62 | | 62.03 | | | | | | | |
| sn-1 + 3 | 36.97 | 4.17 | 4.19 | | 13.98 | | 36.07 | | | | | | | |
| Transgene | 22.63 | 3.12 | 3.46 | 0.77 | 2.35 | 9.51 | 6.37 | 13.03 | 0.74 | 0.83 | 3.87 | 24.96 | 2.22 | 4.15 |
| sn-2 | 1.62 | 0.64 | 8.33 | 1.61 | 5.15 | 16.21 | 10.88 | 19.84 | 0.17 | 1.38 | 1.99 | 24.82 | 3.27 | 3.02 |
| sn-1 + 3 | 33.13 | 4.36 | 1.02 | 0.35 | 0.96 | 6.16 | 4.11 | 9.63 | 1.02 | 0.55 | 4.80 | 25.03 | 1.69 | 4.72 |

TABLE 4

Stereospecific analysis of the phospholipids from leaf material from transgenic *O. violaceus* plants.

| | 16:0 | 16:1 | 18:0 | 18:1n-9 | 18:1n-7 | 18:2n-9 | 18:2n-6 | 18:3n-6 | 18:3n-3 |
|---|---|---|---|---|---|---|---|---|---|
| PG | | | | | | | | | |
| WT | 27.96 | 20.04 | 4.11 | 2.89 | 0.90 | | 21.82 | 0.00 | 21.56 |
| sn-1 | 17.26 | 0.53 | 2.61 | 3.82 | 1.91 | | 39.01 | 0.00 | 34.44 |
| sn-2 | 38.66 | 39.56 | 5.62 | 1.96 | 0.00 | | 4.62 | 0.00 | 8.69 |
| Transgene | 27.15 | 24.70 | 3.08 | 4.62 | 1.20 | 0.00 | 15.15 | 1.53 | 17.94 |
| sn-1 | 21.16 | 3.61 | 4.23 | 7.52 | 2.14 | | 27.40 | 0.50 | 31.57 |
| sn-2 | 33.15 | 45.79 | 1.94 | 1.71 | 0.27 | | 2.90 | 2.57 | 4.30 |
| PE | | | | | | | | | |
| WT | 37.49 | 0.00 | 6.62 | 4.35 | 1.37 | | 19.28 | | 29.95 |
| sn-1 | 54.22 | 0.00 | 7.74 | 3.39 | 3.42 | | 12.64 | | 13.71 |
| sn-2 | 20.77 | 0.00 | 5.51 | 5.31 | 0.00 | | 25.93 | | 46.18 |
| Transgene | 31.78 | 0.81 | 5.84 | 3.08 | 2.20 | 0.85 | 5.57 | 11.25 | 11.34 |
| sn-1 | 50.17 | 0.33 | 10.86 | 3.22 | 4.94 | 0.35 | 2.63 | 3.27 | 3.59 |
| sn-2 | 13.40 | 1.29 | 0.83 | 2.95 | 0.00 | 1.35 | 8.50 | 19.23 | 19.10 |
| PC | | | | | | | | | |
| WT | 27.67 | 0.84 | 6.38 | 8.56 | 1.80 | | 21.75 | | 33.01 |
| sn-1 | 48.05 | 0.44 | 8.65 | 5.05 | 3.41 | | 14.52 | | 18.04 |
| sn-2 | 7.28 | 1.24 | 4.11 | 12.06 | 0.18 | | 28.97 | | 47.98 |
| Transgene | 21.00 | 0.00 | 8.01 | 10.02 | 2.86 | 1.25 | 3.77 | 11.63 | 5.60 |
| sn-1 | 45.35 | 0.00 | 14.71 | 5.08 | 5.70 | 0.31 | 3.23 | 3.09 | 4.58 |
| sn-2 | 3.36 | 0.00 | 1.30 | 14.96 | 0.02 | 2.20 | 4.31 | 20.18 | 6.62 |

| | 18:4n-3 | 20:3n-6 | 20:4n-6 | 20:4n-3 | 20:5n-3 | 22:5n-3 | 22:6n-3 |
|---|---|---|---|---|---|---|---|
| PG | | | | | | | |
| WT | | | | | | | |
| sn-1 | | | | | | | |
| sn-2 | | | | | | | |

TABLE 4-continued

Stereospecific analysis of the phospholipids from leaf material from transgenic O. violaceus plants.

|  |  |  |  |  |  |  |  |
|---|---|---|---|---|---|---|---|
| Transgene | 1.40 | 0.00 | 0.00 | 0.45 | 2.18 | 0.10 | 0.58 |
| sn-1 | 0.81 |  |  | 0.38 | 1.24 | 0.00 | 0.33 |
| sn-2 | 2.00 |  |  | 0.51 | 3.13 | 0.27 | 0.83 |
| PE |  |  |  |  |  |  |  |
| WT |  |  |  |  |  |  |  |
| sn-1 |  |  |  |  |  |  |  |
| sn-2 |  |  |  |  |  |  |  |
| Transgene | 7.38 | 0.00 | 0.00 | 2.88 | 9.41 | 1.90 | 4.90 |
| sn-1 | 2.31 | 0.56 |  | 4.42 | 6.18 | 0.38 | 4.19 |
| sn-2 | 12.45 | 0.00 |  | 1.34 | 12.64 | 3.41 | 5.61 |
| PC |  |  |  |  |  |  |  |
| WT |  |  |  |  |  |  |  |
| sn-1 |  |  |  |  |  |  |  |
| sn-2 |  |  |  |  |  |  |  |
| Transgene | 12.11 | 0.50 | 0.00 | 4.34 | 11.16 | 3.76 | 3.70 |
| sn-1 | 2.65 | 0.61 | 0.08 | 4.01 | 8.32 | 0.41 | 1.18 |
| sn-2 | 21.56 | 0.38 | 0.00 | 4.66 | 13.99 | 7.12 | 6.22 |

TABLE 5

Stereospecific analysis of the galactolipids from leaf material from transgenic O. violaceus plants.

| | 16:0 | 16:1 | 16:2 | 16:3 | 18:0 | 18:1n-9 | 18:1n-7 | 18:2n-9 | 18:2n-6 | 18:3n-6 | 18:3n-3 | 18:4n-3 | 20:3n-6 | 20:4n-6 | 20:4n-3 | 20:5n-3 |
|---|---|---|---|---|---|---|---|---|---|---|---|---|---|---|---|---|
| MGDG | | | | | | | | | | | | | | | | |
| wt | 2.64 | 0.13 | 1.23 | 30.72 | 0.33 | 0.36 | 0.26 | | 3.81 | | 60.52 | | | | | |
| sn-1 | 0.00 | 0.05 | 0.00 | 7.11 | 0.36 | 0.31 | 0.41 | | 4.60 | | 87.30 | | | | | |
| sn-2 | 5.34 | 0.21 | 2.55 | 54.34 | 0.31 | 0.39 | 0.12 | | 3.01 | | 33.74 | | | | | |
| tr | 4.16 | 0.20 | 1.08 | 33.81 | 0.93 | 0.73 | 0.52 | 0.03 | 1.64 | 1.88 | 44.82 | 2.73 | 0.04 | 0.30 | 0.50 | 5.08 |
| sn-1 | 1.22 | 0.29 | 0.54 | 4.79 | 1.51 | 1.15 | 0.93 | 0.00 | 2.80 | 0.14 | 80.19 | 0.00 | 0.08 | 0.17 | 0.87 | 3.86 |
| sn-2 | 7.11 | 0.11 | 1.61 | 62.82 | 0.34 | 0.31 | 0.11 | 0.11 | 0.47 | 3.62 | 9.46 | 5.48 | 0.00 | 0.43 | 0.14 | 6.31 |
| DGDG | | | | | | | | | | | | | | | | |
| wt | 17.67 | 0.19 | 0.38 | 2.15 | 1.61 | 0.51 | 0.94 | | 5.56 | | 70.71 | | | | | |
| sn-1 | 16.84 | 0.25 | 0.50 | 2.52 | 2.21 | 0.55 | 1.75 | | 6.07 | 0.00 | 68.74 | | | | | |
| sn-2 | 18.50 | 0.12 | 0.27 | 1.78 | 1.01 | 0.46 | 0.13 | | 5.05 | | 72.68 | | | | | |
| tr | 18.50 | 0.00 | 0.00 | 2.62 | 2.84 | 1.36 | 1.39 | 0.00 | 6.28 | 3.55 | 54.66 | 0.00 | 0.00 | 0.00 | 2.18 | 5.36 |
| sn-1 | 22.74 | 0.17 | 0.23 | 0.48 | 4.55 | 1.71 | 2.32 | 0.24 | 9.22 | 0.23 | 56.06 | 0.27 | 0.00 | 0.00 | 0.36 | 1.23 |
| sn-2 | 14.27 | 0.00 | 0.00 | 4.77 | 1.12 | 1.00 | 0.46 | 0.00 | 3.33 | 6.88 | 53.26 | 0.00 | 0.00 | 0.00 | 4.01 | 9.49 |

TABLE 6

Gas chromatographic determination of the fatty acids from seeds of transgenic Brassica juncea plants transformed with the construct pSUN-9G in percent by weight. WT describes the unmodified wild-type control.

| | Lipid Profile (%) | | | | | | | |
|---|---|---|---|---|---|---|---|---|
| | 16:0 | 18:0 | 18:1 | 18:2 | γ18:3 | α18:3 | 18:4 | 20:0 |
| BJ223_PUFA184_MKP71_581A | 4.4 | 3.0 | 22.5 | 16.9 | 27.0 | 4.9 | 3.2 | 0.6 |
| BJ223_PUFA184_MKP71_581A | 4.7 | 3.9 | 17.9 | 10.6 | 29.5 | 4.2 | 4.0 | 0.9 |
| BJ223_PUFA184_MKP71_581A | 4.4 | 3.0 | 18.9 | 13.8 | 30.5 | 4.1 | 3.2 | 0.7 |
| BJ223_PUFA184_MKP71_581A | 4.6 | 3.3 | 20.5 | 13.2 | 29.8 | 4.2 | 3.3 | 0.8 |

| | 20:3 (8, 11, 14) | 20:3 (11, 14, 17) | 20:4 (ARA) (6, 8, 11, 14) | 20:4 (ETeA) (8, 11, 14, 17) | 20:5 (EPA) (6, 8, 11, 14, 17) | 22:1 | 22:4 | 22:5 | 22:6 |
|---|---|---|---|---|---|---|---|---|---|
| BJ223_PUFA184_MKP71_581A | 1.1 | 0.5 | 3.1 | 0.6 | 4.6 | 0.0 | 1.5 | 2.0 | 1.5 |
| BJ223_PUFA184_MKP71_581A | 2.0 | 0.9 | 4.2 | 1.0 | 4.1 | 0.0 | 3.1 | 3.5 | 1.9 |
| BJ223_PUFA184_MKP71_581A | 1.3 | 0.7 | 4.1 | 0.5 | 4.5 | 0.0 | 2.7 | 2.8 | 1.6 |
| BJ223_PUFA184_MKP71_581A | 1.4 | 0.6 | 3.6 | 0.6 | 4.4 | 0.0 | 2.4 | 2.5 | 1.6 |

SEQUENCE LISTING (221 sequences)

SEQ ID NO: 1 - DNA, 1380 bp, Phytium irregulare
  CDS (1)..(1380)
atggtggacctcaagcctggagtgaagcgcctggtgagctggaaggagatccgcgagcacgcgacgcccgcgaccgcgtggatcgtgattcaccacaaggtctacgacatctccaagtgggactcgcacccgggtggctccgtgatgctcacgcaggccggcgaggacgccacggacgccttcgcggtcttccacccgtcctcggcgctcaagctgctcgagcagttctacgtcggcgacgtggacgaaacctccaaggccgagatcgagggggagccggcgagcgacgaggagcgcgcgcgccgcgagcgcatcaacgagttcatcgcgtcctaccgccgtctgcgcgtcaaggtcaagggcatggggctctacgacgccagcgcgctctactacgcgtggaagctcgtgagcacgttcggcatcgcggtgctctcgatggcgatctgcttcttcttcaacagtttcgccatgtacatggtcgccggcgtgattatggggctcttctaccagcagtccggatggctggcgcacgacttcttgcacaaccaggtgtgcgagaaccgcacgctcggcaaccttatcggctgcctcgtgggcaacgcctggcagggcttcagcatgcagtggtggaagaacaagcacaacctgcaccacgcggtgccgaacctgcacagcgccaaggacgagggcttcatcggcgacccggacatcgacaccatgccgctgctggcgtggtctaaggagatggcgcgcaaggcgttcgagtcggcgcacggcccgttcttcatccgcaaccaggcgttcctatacttcccgctgctgctgctcgcgcgcctgagctggctcgcgcagtcgttcttctacgtgttcaccgagttctcgttcggcatcttcgacaaggtcgagttcgacggaccggagaaggcgggtctgatcgtgcactacatctggcagctcgcgatcccgtacttctgcaacatgagcctgtttgagggcgtggcatacttcctcatgggccaggcgtcctgcggcttgctcctggcgctggtgttcagtattggccacaacggcatgtcggtgtacgagcgcgaaaccaagccggacttctggcagctgcaggtgaccacgacgcgcaacatccgcgcgtcggtattcatggactggttcaccggtggcttgaactaccagatcgaccatcacctgttcccgctcgtgccgcgccacaacttgccaaaggtcaacgtgctcatcaagtcgctatgcaaggagttcgacatcccgttccacgagaccggcttctgggagggcatctacgaggtcgtggaccacctggcggacatcagcaaggaatttatcaccgagttcccagcgatgtaa

SEQ ID NO: 2 - protein, 459 aa, Phytium irregulare
MVDLKPGVKRLVSWKEIREHATPATAWIVIHHKVYDISKWDSHPGGSVMLTQAGEDATDAFAVFHPSSALKLLEQFYVGDVDETSKAEIEGEPASDEERARRERINEFIASYRRLRVKVKGMGLYDASALYYAWKLVSTFGIAVLSMAICFFFNSFAMYMVAGVIMGLFYQQSGWLAHDFLHNQVCENRTLGNLIGCLVGNAWQGFSMQWWKNKHNLHHAVPNLHSAKDEGFIGDPDIDTMPLLAWSKEMARKAFESAHGPFFIRNQAFLYFPLLLLARLSWLAQSFFYVFTEFSFGIFDKVEFDGPEKAGLIVHYIWQLAIPYFCNMSLFEGVAYFLMGQASCGLLLALVFSIGHNGMSVYERETKPDFWQLQVTTTRNIRASVFMDWFTGGLNYQIDHHLFPLVPRHNLPKVNVLIKSLCKEFDIPFHETGFWEGIYEVVDHLADISKEFITEFPAM

SEQ ID NO: 3 - DNA, 1380 bp, Rhizopus stolonifer
  CDS (1)..(1380)
atgagtacattagatcgtcaatctattttcacaataaaggaattagagtcgatcagtcaacgtattcatgatggagatgaagaggctatgaagttcattattatcgacaagaaggtgtacgatgttactgaatttattgaagaccaccctggtggtgctcaagttttgttgactcatgttgggaaagatgcatctgacgtatttcatgccatgcatcccgaatctgcttacgaagtcttgaacaattacttcgtaggcgatgttcaagaaacagtagtcactgaaaaatcttcttctgcccaattcgctgtagaaatgcgtcagcttcgggatcaattgaaaaaggaaggttatttccactccagcaaactcttttatgcttacaaagttctttctactttggctatctgcatagctggtctctctcctttgtatgcttatggtcgtacttccactttggctgtcgtcgcatctgctattactgttggtatcttttggcaacagtgtggttggctggctcacgatttcggacatcatcaatgcttcgaagaccgcacttggaacgatgttctcgtcgtatttctcggaaacttttgtcaaggattttcattatcatggtggaagaacaagcacaacacacatcacgcaagtacaaatgttcatggacaggatcccgacattgacacagcccctgttttgttgtgggatgaatatgcttctgcagcttactatgcttctctcgatcaagaacccacaatggtatctcgattccttgctgaacaagtcttgccccaccaaacccgttattttttctttatcctcgcttttgctcgtttgtcttgggctcttcaatctttgagctactctttcaagaaggagtcaattaacaagtcccgtcaacttaacctttttgaacgtgtttgtattgttggtcactgggctctctctgctttttgtatctactcttggtgtagcaacgtctatcacatggttttgtttttcttggttagtcaggctaccacaggctacactttagctcttgtctttgctttgaaccacaatggtatgcctgttatcactgaagaaaaggctgaatcgatggaattttttgagattcaagttatcactggtcgcgatgttactctttcccccttgggtgattggttcatgggtggtttgaactatcaaatcgaacatcatgttttccccaacatgcctcgtcacaacttgcctacagttaagcccatggtgaaatcgctttgtcagaaatatgacattaactatcacgatactggattcttaaagggaacattagaagtattacaaacactggatattacatccaagctctctttgcaattaagcaaaaagtcgttttaa

SEQ ID NO: 4 - protein, 459 aa, Rhizopus stolonifer
MSTLDRQSIFTIKELESISQRIHDGDEEAMKFIIIDKKVYDVTEFIEDHPGGAQVLLTHVGKDASDVFHAMHPESAYEVLNNYFVGDVQETVVTEKSSSAQFAVEMRQLRDQLKKEGYFHSSKLFYAYKVLSTLAICIAGLSPLYAYGRTSTLAVVASAITVGIFWQQCGWLAHDFGHHQCFEDRTWNDVLVVFLGNFCQGFSLSWWKNKHNTHHASTNVHGQDPDIDTAPVLLWDEYASAAYYASLDQEPTMVSRFLAEQVLPHQTRYFFFILAFARLSWALQSLSYSFKKESINKSRQLNLFERVCIVGHWALSAFCIYSWCSNVYHMVLFFLVSQATTGYTLALVFALNHNGMPVITEEKAESMEFFEIQVITGRDVTLSPLGDWFMGGLNYQIEHHVFPNMPRHNLPTVKPMVKSLCQKYDINYHDTGFLKGTLEVLQTLDITSKLSLQLSKKSF

SEQ ID NO: 5 - DNA, 1380 bp, Rhizopus stolonifer
  CDS (1)..(1380)
atgagtacattagatcgtcaatctattttcacaataaaggaattagagtcgatcagtcaacgtattcatgatggagatgaagaggctatgaagttcattattatcgacaagaaggtgtacgatgttactgaatttattgaagaccaccctggtggtgctcaagttttgttgactcatgttgggaaagatgcatctgacgtatttcatgccatgcatcccgaatctgcttacgaagtcttgaacaattacttcgtaggcgatgttcaagaaacagtagtcactgaaaaatcttcttctgcccaattcgctgtagaaatgcgtcagcttcgggatcaattgaaaaaggaaggttatttccactccagcaaactcttttatgcttacaaagttctttctactttggctatctgcatagctggtctctctcttttgtatgcttatggtcgtacttccactttggctgtcgtcgcatctgctattactgttggtatcttttggcaacagtgtggttggctggctcacgatttcggacatcatcaatgcttcgaagaccgcacttggaacgatgttctcgtcgtatttctcggaaacttttgtcaaggattttcattatcatggtggaagaacaagcacaacacacatcacgcaagtacaaatgttcatggacaggatcccgacattgacacagcccctgttttgttgtgggatgaatatgcttctgcagcttactatgcttctctcgatcaagaacccacaatggtatctcgattccttgctgaacaagtcttgccccaccaaacccgttattttttctttatcctcgcttttgctcgtttgtcttgggctcttcaatctttgagctactctttcaagaaggagtcaattaacaagtcccgtcaacttaacctttttgaacgtgtttgtattgttggtcactgggctctctttgctttttgtatctactcttggtgtagcaacgtctatcacatggttttgtttttcttggttagtcaggctaccacaggctacactttagctcttgtctttgctttgaaccacaatggtatgcctgttatcactgaagaaaaggctgaatcgatggaattttttgagattcaagttatcactggtcgtgatgttactctttcccccttgggtgattggttcatgggtggtttgaactatcaaatcgaacatcatgttttccccaacatgcctcgtcacaacttgcctacagttaagcccatggtgaaatcgctttgtcagaaatatgacattaactatcacgatactggattcttaaagggaacattagaagtattacaaacactggatattacatccaagctctctttgcaattaagcaaaaagtcgttttaa

SEQ ID NO: 6 - protein, 459 aa, Rhizopus stolonifer
MSTLDRQSIFTIKELESISQRIHDGDEEAMKFIIIDKKVYDVTEFIEDHPGGAQVLLTHVGKDASDVFHAMHPESAYEVLNNYFVGDVQETVVTEKSSSAQFAVEMRQLRDQLKKEGYFHSSKLFYAYKVLSTLAICIAGLSLLYAYGRTSTLAVVASAITVGIFWQQCGWLAHDFGHHQCFEDRTWNDVLVVFLGNFCQGFSLSWWKNKHNTHHASTNVHGQDPDIDTAPVLLWDEYASAAYYASLDQEPTMVSRFLAEQVLPHQTRYFFFILAFARLSWALQSLSYSFKKESINKSRQLNLFERVCIVGHWALFAFCIYSWCSNVYHMVLFFLVSQATTGYTLALVFALNHNGMPVITEEKAESMEFFEIQVITGRDVTLSPLGDWFMGGLNYQIEHHVFPNMPRHNLPTVKPMVKSLCQKYDINYHDTGFLKGTLEVLQTLDITSKLSLQLSKKSF

SEQ ID NO: 7 - DNA, 1401 bp, Cunninghamella echinulata
  CDS (1)..(1401)
atgtcagggcaaactcgagtttttaagcgatccgaagtgtccgattcgctcaaggcgtaccaagcgggcgacaagaacgccgacaagttcctgattgtcgacaacaaggtgtacgacatcacggatttcattgctgatcatcctggcggtgctcaggtcatctctacgcacattggcaaggatgcctctgatgtgtttcatgcgatgcatcccgagtctgcgtacgaattgcttgcgaattgctacgttggcgatcttgctgcggaccatgctggtgtgcagggcgaattggtgaatggtgtacacaaaaagtccaaggcatttgcggacgagatgcgatcgttgcgcgagcgtcttgagacggagggtgcctttaatggcagtgttccgttttacatttacaaggtggtgtcgacgttggccattggtgcgacgggtctggccatgctgtactatggcggccattcgacgtcggtcgtgcttgcggcggcggtggttgtcggtctgttttggcaacagtgcggctggctcgcccacgactttggccaccaccaggcgtttgcggaccatacggtcaatgacgtgatgattgcgtttttgggtggattctgccaaggtttctcgctgtcgtggtggaagaacaagcacaacactcaccacgcctccaccaacgtccacggccacgatcccgatatcgatacggcccctgtcctcctctgggacgaatttgccaccgccaatttctatggaaacctcgagggtcaaaaggattcggcgttctcgcgcttcattgccgaacacgtgctcccctaccagacgcgctattacttttttgtcctcggctttgcgcgtctctcgtgggccatccaatcgctccaatactcgttcactgtcggcacactcaacaagtcaaagaccctcaatctgtttgagcgcaccatgcttgtcagccattggatcttgttcaccacttggacgctcctcttcatcaattcatggaccaacatggtcatgttctttgtcgtcagccaggccaccaccggctacgcgcttgccctcgttttcgccatgaaccactcgggcatgcccgtcctcacccaagaacaggcccaaaagatggagttctacgagatccaggtcgtcaccgcccgcgacgtcaccctcggtgcccttggcgactggttctgcggcggcctcaactatcaaatcgagcaccatgtattccctgatatgccccgccactacctgcccaaggtcaagcctcaagtcaaggctctctgcaaaaaacacaacattttgtaccatgatacctctgctttgcgcggcaccttggaagtgctgcaaaccttggatgttgtccaaaagctctgcgcaagttctctcaaaagatgttttagatga

SEQ ID NO: 8 - protein, 466 aa, Cunninghamella echinulata
MSGQTRVFKRSEVSDSLKAYQAGDKNADKFLIVDNKVYDITDFIADHPGGAQVISTHIGKDASDVFHAMHPESAYELLANCYVGDLAADHAGVQGELVNGVHKKSKAFADEMRSLRERLETEGAFNGSVPFYIYKVVSTLAIGATGLAMLYYGGHSTSVVLAAAVVVGLFWQQCGWLAHDFGHHQAFADHTVNDVMIAFLGGFCQGFSLSWWKNKHNTHHASTNVHGHDPDIDTAPVLLWDEFATANFYGNLEGQKDSAFSRFIAEHVLPYQTRYYFFVLGFARLSWAIQSLQYSFTVGTLNKSKTLNLFERTMLVSHWILFTTWTLLFINSWTNMVMFFVVSQATTGYALALVFAMNHSGMPVLTQEQAQKMEFYEIQVVTARDVTLGALGDWFCGGLNYQIEHHVFPDMPRHYLPKVKPQVKALCKKHNILYHDTSALRGTLEVLQTLDVVQKLCASSLKRCFR

SEQ ID NO: 9 - DNA, 1398 bp, Glossomastix chrysoplasta
  CDS (1)..(1398)
atgggtaaaggaggccgggacgccggcgctgtcggcggcgaagcggagaagacgctgcccaagtttacgttggaggagatccagaagcatcgcacgccgcaggatgcgtggatggtgcaccacaacaaggtgtacgatgtgtccaactatatggaccaccccggcggtctggtgatctttagccacgcgggcgatgacatgaccgacgtcttcgcggcgttccacccgccctcggcgttcaacttcatggacaagttcttgattggcgtggtggacagcaagggctcgtcgccgcagctccagaaggacgcgtcccaggccagcttcgagaaggcataccgcaatctgcgagtccagctcaagaaggccggcatgttcaaggcctcgagcctcttctacacctacaaggtgctctcgaccctggcgctgtgcctcgtgtcctggggcctcgtgctggggtcggaccacttcggtgtgcacctcgtgggcgctctcttcctcgcgctcttctggcagcagtgcggctggttggcccacgacttcctgcaccaccaggtcttccagaaccgggctcacggcgacctcgccggtatcatgatcggcaacgtgtggcagggcttctccgtggcctggtggaagaacaagcacaacacccaccactcggtgccgaacctctacgagtcgcagcccgacgccgccgacggcgatccggacatcgacaccatgcccctcctcgcctggtcgctgcgcatggccaagaacgcggacaacgcgctatcccggtggttcgtgtcccaccaggccttctgctacttccccatccttggcctcgcgcggctctcgtggctcgaggggtccttctccttcgtgttctccaacccgttggcatggaagacgaagaaccttgatgtagccaagcagctcgtgaccaaccccctgttggagcaggccggcctcctggtccactacgcctgggtcttcgccctctgcgcgtgcacgggctccctggtgcgcgccctggcgttcttcttcgtggccacctgcaccagcggccttctcctcgccatcgtcttcggcctcggccacaacggcatggcgctctacgaggccaatgcccggccggacttctggaagctccaggtgaccaccacgcggaacatcaccggcagcccctttgtgcactggttctgcggcggcctccagttccaggtggagcaccacctcttcccctcgctgccccggcacaacctcccccgggcccacgagatcgtgacggccttctgcaaggagcagggcgtcaagtaccacgaggccgacctccttaccgggaccaaggagattctttcgtgcttgtcggaggtaacgacggagttcctcgacgagttcccagccatgtaa

SEQ ID NO: 10 - protein, 465 aa, Glossomastix chrysoplasta
MGKGGRDAGAVGGEAEKTLPKFTLEEIQKHRTPQDAWMVHHNKVYDVSNYMDHPGGLVIFSHAGDDMTDVFAAFHPPSAFNFMDKFLIGVVDSKGSSPQLQKDASQASFEKAYRNLRVQLKKAGMFKASSLFYTYKVLSTLALCLVSWGLVLGSDHFGVHLVGALFLALFWQQCGWLAHDFLHHQVFQNRAHGDLAGIMIGNVWQGFSVAWWKNKHNTHHSVPNLYESQPDAADGDPDIDTMPLLAWSLRMAKNADNALSRWFVSHQAFCYFPILGLARLSWLEGSFSFVFSNPLAWKTKNLDVAKQLVTNPLLEQAGLLVHYAWVFALCACTGSLVRALAFFFVATCTSGLLLAIVFGLGHNGMALYEANARPDFWKLQVTTTRNITGSPFVHWFCGGLQFQVEHHLFPSLPRHNLPRAHEIVTAFCKEQGVKYHEADLLTGTKEILSCLSEVTTEFLDEFPAM

SEQ ID NO: 11 - DNA, 1455 bp, Thalassiosira pseudonana
  CDS (1)..(1455)
atgggaaaaggaggagacgcagccgcagctaccaagcgtagtggagcattgaaattggcggagaagccgcagaagtacacttggcaggaggtgaagaagcacatcacccccgacgatgcctgggtagtccaccaaaacaaagtctacgacgtctccaactggtacgaccaccccggtggagccgtggtgttcacccacgccggagacgacatgacggacatcttcgccgccttccacgcccaaggctctcaggccatgatgaagaagttttacattggagatttgattccggagagtgtggagcataaggatcaaagacagttggatttcgagaagggatatcgtgatttacgggccaagcttgtcatgatggggatgttcaagtcgagtaagatgtattatgcatacaagtgctcgttcaatatgtgcatgtggttggtggcggtggccatggtgtactactcggacagtttggcaatgcacattggatcggctctcttgttgggattgttctggcagcagtgtggatggcttgcgcacgactttcttcaccaccaagtctttaagcaacgaaagtacggagatctcgttggcatcttttggggagatctcatgcaggggttctcgatgcagtggtggaagaacaagcacaatggccaccatgctgttcccaacttgcacaactcttccttggacagtcaggatggtgatcccgatattgataccatgccactccttgcttggagtctcaagcaggctcagagtttcagagagatcaataagggaaaggacagtaccttcgtcaagtacgctatcaaattccaggcattcacatacttccccatcctcctcttggctcgcatctcttggttgaatgaatccttcaaaactgcattcggactcggagctgcctcggagaatgccaagttggagttggagaagcgtggacttcagtacccacttttggagaagcttggaatcacccttcactacacttggatgttcgtcctctcttccggatttggaaggtggtctcttccatattccatcatgtatttcttcactgccacatgctcctcgggacttttcctcgcattggtctttggattgggacacaacggtatgtcagtgtacgatgccaccacccgacctgacttctggcaactccaagtcaccactacacgtaacatcattggtggacacggcattccccaattctttgtggattggttctgcggtggattgcaataccaagtggatcaccacctcttccccatgatgcctagaaacaatatcgcgaagtgccacaagcttgtggagtcattctgtaaggagtggggtgtgaagtaccatgaggctgatatgtgggatggtaccgtggaagtgttgcaacatctctccaaggtgtcggatgatttccttgtggagatggtgaaggatttccctgccatgtaa

SEQ ID NO: 12 - protein, 484 aa, Thalassiosira pseudonana
MGKGGDAAAATKRSGALKLAEKPQKYTWQEVKKHITPDDAWVVHQNKVYDVSNWYDHPGGAVVFTHAGDDMTDIFAAFHAQGSQAMMKKFYIGDLIPESVEHKDQRQLDFEKGYRDLRAKLVMMGMFKSSKMYYAYKCSFNMCMWLVAVAMVYYSDSLAMHIGSALLLGLFWQQCGWLAHDFLHHQVFKQRKYGDLVGIFWGDLMQGFSMQWWKNKHNGHHAVPNLHNSSLDSQDGDPDIDTMPLLAWSLKQAQSFREINKGKDSTFVKYAIKFQAFTYFPILLLARISWLNESFKTAFGLGAASENAKLELEKRGLQYPLLEKLGITLHYTWMFVLSSGFGRWSLPYSIMYFFTATCSSGLFLALVFGLGHNGMSVYDATTRPDFWQLQVTTTRNIIGGHGIPQFFVDWFCGGLQYQVDHHLFPMMPRNNIAKCHKLVESFCKEWGVKYHEADMWDGTVEVLQHLSKVSDDFLVEMVKDFPAM

SEQ ID NO: 13 - DNA, 1446 bp, Marchantia polymorpha
  CDS (1)..(1446)
atggcctcgtccaccaccaccgccgtgaagcaatcttcgggtgggctgtggtcgaaatggggcaccggcagcaacttgagcttcgtgtcgcgcaaggagcagcagcagcagcagcagcagagctctcccgaggcgtcgactcccgcggcgcagcaggagaaatccatcagtagagaatccatccccgagggcttcttgaccgtggaggaggtgtcgaagcacgacaatccgagcgactgctggatcgtcatcaacgacaaggtgtacgacgtgagcgcattcgggaagacgcatccgggcggccctgtgatcttcacgcaggccggccgcgacgccacggattctttcaaggttttccactccgccaaggcgtggcagtttctccaggacctgtacatcggagatctgtacaatgccgagccagtgtcggagctggtgaaggattaccgagacctgaggacggcgttcatgcgttctcagctattcaagagcagtaaaatgtactacgtgaccaagtgcgtcacaaattttgcaattcttgccgccagtctcgcagtcatcgcgtggagccagacgtatctggcggttttgtgctccagtttcctgttggctctcttctggcagcaatgtggatggttatcgcacgattttctccaccaccaggtgaccgagaaccgatcgctcaacacgtacttcggcggcctgttctggggtaacttcgcccagggctacagcgtgggatggtggaagaccaagcacaatgtgcaccacgcggccacgaacgaatgcgacgacaagtatcagcccatcgatcccgacatcgacaccgtgcccctgctcgcctggagcaaggaaatcttggccaccgtcgacgaccaattcttccgatcgatcatcagcgtgcagcaccttctgttcttcccgctcctcttcttggcaagattcagctggctgcattcgagttgggcccacgccagcaacttcgagatgcctcggtacatgagatgggcggagaaggcctcgctcctcgggcactacggcgcctcaatcggcgccgccttctacattttgcccatcccccaggccatctgctggctcttcttgtcgcaactgttttgcggcgctctgctcagcattgtcttcgtgatcagccacaatggcatggatgtgtacaacgacccccgggacttcgtgacggcccaagtcacctcgaccagaaacatcgaaggcaacttcttcaacgactggttcaccggaggcctgaacaggcagattgagcaccatctgtttccgtctcttccgaggcacaacctcgccaaggtcgcgccacacgtcaaggcgctctgcgccaagcacggtttgcattacgaagaattgagtctgggcacgggagtctgtcgtgtcttcaatcggctagtagaggtagcatacgctgcgaaagtatag

SEQ ID NO: 14 - protein, 481 aa, Marchantia polymorpha
MASSTTTAVKQSSGGLWSKWGTGSNLSFVSRKEQQQQQQQSSPEASTPAAQQEKSISRESIPEGFLTVEEVSKHDNPSDCWIVINDKVYDVSAFGKTHPGGPVIFTQAGRDATDSFKVFHSAKAWQFLQDLYIGDLYNAEPVSELVKDYRDLRTAFMRSQLFKSSKMYYVTKCVTNFAILAASLAVIAWSQTYLAVLCSSFLLALFWQQCGWLSHDFLHHQVTENRSLNTYFGGLFWGNFAQGYSVGWWKTKHNVHHAATNECDDKYQPIDPDIDTVPLLAWSKEILATVDDQFFRSIISVQHLLFFPLLFLARFSWLHSSWAHASNFEMPRYMRWAEKASLLGHYGASIGAAFYILPIPQAICWLFLSQLFCGALLSIVFVISHNGMDVYNDPRDFVTAQVTSTRNIEGNFFNDWFTGGLNRQIEHHLFPSLPRHNLAKVAPHVKALCAKHGLHYEELSLGTGVCRVFNRLVEVAYAAKV

SEQ ID NO: 15 - DNA, 1377 bp, Rhizopus oryzae
  CDS (1)..(1377)
atgagtacatcagatcgtcaatcagttttcacattaaaagagttggaactgattaatcaaaaacatcgagatggagataaaagtgcgatgaagttcattatcattgatcgtaaggtgtacgatgtgactgaattcttggaagatcatcctggtggtgcacaagtattactgacacacgttggaaaagatgcatctgatgtatttcatgccatgcatcccgagtcagcatatgaaatcttgaacaattattttgtaggagatgtaaaagatgcacatgtaaaggagaccccttctgctcaatttgcttcagaaatgcgtcaacttcgggatcaattgaaaaaagaaggttattttcattctagtaaagcttattatgtttacaaggtcctctctactcttgctctttgtgcagctggtcttactcttttgtatgcttatggacatacatctactttagctgttgttgcatctgctattattgttggtatcttttggcaacaatgtggttggttggctcatgattttggacatcatcaatgctttgaagatcgctcttggaatgatgttcttgttgttttccttggaaacttttgtcaaggtttttcattgtcatggtggaagaataaacataacactcaccacgctagtacgaatgttcatggacatgatcccgatattgacactgctcctgtcttattatgggatgaatatgcatctgcagcttattatgcctcactggatgaagaacccacaatgatttctcgattccttgctgaaagtgtcttgcctcatcaaactcgttattacttctttgttctcggctttgctcgtttatcatgggccatccaatccttactctactcattcaaacaaggtgctattaacaagtctcatcaactcaacctctttgaacgcttttgtcttgttagtcactggactttattcacttactgtacacttgcctggtgtagcaacgtctatcacatgattttgttctttttggttagtcaagcaactaccggttacacattggcccttgtatttgctttgaatcacaatggtatgcctgtgattactgaagaaaaggccgagtcaatggaatttttcgaaattcaagtgattacaggtcgtgatgtaacactctctcctttaggtgattggttcatgggtggattgaactatcaaatcgagcatcatgttttccctaatatgcctcgtcataatttacctaaagtaaagccaatggtcaagtcactttgtaagaaatatgatattaattatcacgatactggattcttgaaaggaacattggaagtactaaagacattagatattacttccaagttgtctttgcaattgagcaaaaagtcattttaa

SEQ ID NO: 16 - protein, 458 aa, Rhizopus oryzae
MSTSDRQSVFTLKELELINQKHRDGDKSAMKFIIIDRKVYDVTEFLEDHPGGAQVLLTHVGKDASDVFHAMHPESAYEILNNYFVGDVKDAHVKETPSAQFASEMRQLRDQLKKEGYFHSSKAYYVYKVLSTLALCAAGLTLLYAYGHTSTLAVVASAIIVGIFWQQCGWLAHDFGHHQCFEDRSWNDVLVVFLGNFCQGFSLSWWKNKHNTHHASTNVHGHDPDIDTAPVLLWDEYASAAYYASLDEEPTMISRFLAESVLPHQTRYYFFVLGFARLSWAIQSLLYSFKQGAINKSHQLNLFERFCLVSHWTLFTYCTLAWCSNVYHMILFFLVSQATTGYTLALVFALNHNGMPVITEEKAESMEFFEIQVITGRDVTLSPLGDWFMGGLNYQIEHHVFPNMPRHNLPKVKPMVKSLCKKYDINYHDTGFLKGTLEVLKTLDITSKLSLQLSKKSF

SEQ ID NO: 17 - DNA, 1404 bp, Mucor rouxii
  CDS (1)..(1404)
atgagcagcgacgtaggagcaacagtaccccatttttatactcgtgctgaattggctgatatccatcaagatgttctggacaagaaacctgaagctagaaaactaattgtcgtcgagaataaggtatacgatatcacagatttcgtatttgatcaccctggcggtgagcgagtacttttgactcaagagggcagagacgctacagatgtctttcatgaaatgcatcctccctctgcttacgaattgctggcgaattgctatgttggcgattgtgagcccaagctgcctatcgattcaaccgataagaaggcattgaattctgctgcttttgctcaagaaattcgtgatctccgagataaattagaaaaacaaggctatttcgacgctagtactggtttctacatctataaagtttccactaccctacttgtctgtattgtaggtttagctatcctcaaagcttggggtagagagtctactttggctgtgtttattgctgcttctttagttggtcttttttggcagcagtgcggttggcttgcccatgattatgctcactatcaagtcatcaaagaccccaatgtcaataatctctttttagttacttttggcaacctggttcaaggtttctctctttcatggtggaaaaacaagcacaatacccaccacgctagcaccaatgtctctggcgaagatcccgatatcgatactgcccccattttgctatgggacgagtttgcagtcgctaatttctatggatccttgaaggacaatgccagtggatttgacagattcattgctgaacacattttgccctatcaaactcgttactacttcttcattcttggtttcgctcgtacctcttgggctatccaatctattatctattccttcaagaacgaaacattgaataaatcaaagctcttgtcctggtgtgagcgcatctttttgattgttcattgggtctttttcacttactgcactattgcctggatcagctctatcagaaacatcgccatgttctttgttgttagccaaatcactactggttacttgctcgccatcgtctttgctatgaaccataatggcatgcctgtttacagccccgaagaagcaaaccataccgagttttatgaattgcagtgtatcactggtcgcgatgtcaactgcactgtatttggcgattggctcatgggtggattgaattatcaaattgagcaccatcttttccccgaaatgcctcgacatcatttatccaaggtgaaatccatggtcaaacccattgctcaaaagtataatatcccttaccatgataccacagtcattggtggtaccattgaagtcttgcaaaccttggattttgttcaaaagatttcgcagaaattcagcaaaaaaatgctctaa

SEQ ID NO: 18 - protein, 467 aa, Mucor rouxii
MSSDVGATVPHFYTRAELADIHQDVLDKKPEARKLIVVENKVYDITDFVFDHPGGERVLLTQEGRDATDVFHEMHPPSAYELLANCYVGDCEPKLPIDSTDKKALNSAAFAQEIRDLRDKLEKQGYFDASTGFYIYKVSTTLLVCIVGLAILKAWGRESTLAVFIAASLVGLFWQQCGWLAHDYAHYQVIKDPNVNNLFLVTFGNLVQGFSLSWWKNKHNTHHASTNVSGEDPDIDTAPILLWDEFAVANFYGSLKDNASGFDRFIAEHILPYQTRYYFFILGFARTSWAIQSIIYSFKNETLNKSKLLSWCERIFLIVHWVFFTYCTIAWISSIRNIAMFFVVSQITTGYLLAIVFAMNHNGMPVYSPEEANHTEFYELQCITGRDVNCTVFGDWLMGGLNYQIEHHLFPEMPRHHLSKVKSMVKPIAQKYNIPYHDTTVIGGTIEVLQTLDFVQKISQKFSKKML

SEQ ID NO: 19 - DNA, 1374 bp, Mortierella alpina
  CDS (1)..(1374)
atggctgctgctcccagtgtgaggacgtttactcgggccgagattttgaatgccgaggctctgaatgagggcaagaaggatgccgaggcacccttcctgatgatcatcgacaacaaggtgtacgatgtccgcgagttcgtccctgatcatcccggtggaagtgtgattctcacgcacgttggcaaggacggcactgacgtctttgacacttttcaccccgaggctgcttgggagactcttgccaacttttacgttggtgatattgacgagagcgaccgcgatatcaagaatgatgactttgcggccgaggtccgcaagctgcgtaccttgttccagtctcttggttactacgattcttccaaggcatactacgccttcaaggtctcgttcaacctctgcatctggggtttgtcgacggtcattgtggccaagtggggccagacctcgaccctcgccaacgtgctctcggctgcgcttttgggtctgttctggcagcagtgcggatggttggctcacgactttttgcatcaccaggtcttccaggaccgtttctggggtgatcttttcggcgccttcttgggaggtgtctgccagggcttctcgtcctcgtggtggaaggacaagcacaacactcaccacgccgcccccaacgtccacggcgaagatcccgacattgacacccaccctctgttgacctggagtgagcatgcgttggagatgttctcggatgtcccagatgaggagctgacccgcatgtggtcgcgtttcatggtcctgaaccagacctggttttacttccccattctctcgtttgcccgtctctcctggtgcctccagtccattctctttgtgctgcctaacggtcaggcccacaagccctcgggcgcgcgtgtgcccatctcgttggtcgagcagctgtcgcttgcgatgcactggacctggtacctcgccaccatgttcctgttcatcaaggatcccgtcaacatgctggtgtactttttggtgtcgcagccggtgtgcggaaacttgttggcgatcgtgttctcgctcaaccacaacggtatgcctgtgatctcgaaggaggaggcggtcgatatggatttcttcacgaagcagatcatcacgggtcgtgatgtccacccgggtctatttgccaactggttcacgggtggattgaactatcagatcgagcaccacttgttcccttcgatgcctcgccacaacttttcaaagatccagcctgctgtcgagaccctgtgcaaaaagtacaatgtccgataccacaccaccggtatgatcgagggaactgcagaggtctttagccgtctgaacgaggtctccaaggctgcctccaagatgggcaaggcacagtaa

SEQ ID NO: 20 - protein, 457 aa, Mortierella alpina
MAAAPSVRTFTRAEILNAEALNEGKKDAEAPFLMIIDNKVYDVREFVPDHPGGSVILTHVGKDGTDVFDTFHPEAAWETLANFYVGDIDESDRDIKNDDFAAEVRKLRTLFQSLGYYDSSKAYYAFKVSFNLCIWGLSTVIVAKWGQTSTLANVLSAALLGLFWQQCGWLAHDFLHHQVFQDRFWGDLFGAFLGGVCQGFSSSWWKDKHNTHHAAPNVHGEDPDIDTHPLLTWSEHALEMFSDVPDEELTRMWSRFMVLNQTWFYFPILSFARLSWCLQSILFVLPNGQAHKPSGARVPISLVEQLSLAMHWTWYLATMFLFIKDPVNMLVYFLVSQPVCGNLLAIVFSLNHNGMPVISKEEAVDMDFFTKQIITGRDVHPGLFANWFTGGLNYQIEHHLFPSMPRHNFSKIQPAVETLCKKYNVRYHTTGMIEGTAEVFSRLNEVSKAASKMGKAQ

SEQ ID NO: 21 - DNA, 1377 bp, Mortierella alpina
  CDS (1)..(1377)
atgaccaccagcgacccatctgtcagagcgttcacacgctcagaagtgttgcacgccgatgccttgaacgagggcaaaaagaacgccgaggcaccgtttctcatgatcatcgacaacaaggtctacgatgtgcgcgagtttatccccgaccatcctggtgggagcgtcattttgacccacgtaggcaaggacggcaccgacgttttcgagaccttccatcctgaggctgcttgggagacgctcgccaatttttatgtcggtgacattgtagaatccgatcgcgccatcgagaacgacgagtttgcagctgaggttcgtaagctgcggacattgttttattctttgggctactacgactcatccaaggtttactacgccttcaaggtctcgttcaacctctgcatctggggcctgtctgcattcattgttgccaaatggggccagacctcgaccctcgcaaacgtgatatcagcctcactcctgggtgtcttttggcaacagtgcggttggctcgcccatgatttcttgcaccatcaggtctttcacgatcgattctggggcgatctgttcggtgcatttctcggcggagtctgtcaaggtttctcctcgtcctggtggaaggacaaacacaacacccaccacgcggcgcccaatgtccatggagaggatcccgatatcgacacacatccgcttttgacgtggagtgagcatgcgctcgagatgttttcggatgtgcccgatgaggagcttacccaaatgtggtcccggtttatggttctgaaccaggcctggttttactttcccattctgtcatttgcccgcctgtcctggtgcatccagtcgattctttttgtgctaccgaacggacaggcacacaaacctgcgggggctcgggttcccatctcgctggtggagcaattgtcgttggcgatgcactggacctggtacctggcaaccatgttcctgttcatcaaggatcccgtcaacatgatggtgtatttcttggtctcgcaagctgtctgcggcaacctgttagcgattgtgttctcgctgaaccataacggtatgcctgtgatctcgcaggaggaagcggtcgagatggatttcttcacaaagcagatcattacgggtcgtgatgtctacccgggttggtttgcagactggttcacgggtggattgaactatcagattgaacaccatctgttcccgtcgatgcctcgacaccatttctcaaagatccagcccgcggttgaatcgctgtgcaagaagtacggggtccgataccatacgacggggatgattgctggcaccgcagaggtcttttcgcgactgaacgaggtgtcccaggctgcaagcaagctcggcaagtctgcttga

SEQ ID NO: 22 - protein, 458 aa, Mortierella alpina
MTTSDPSVRAFTRSEVLHADALNEGKKNAEAPFLMIIDNKVYDVREFIPDHPGGSVILTHVGKDGTDVFETFHPEAAWETLANFYVGDIVESDRAIENDEFAAEVRKLRTLFYSLGYYDSSKVYYAFKVSFNLCIWGLSAFIVAKWGQTSTLANVISASLLGVFWQQCGWLAHDFLHHQVFHDRFWGDLFGAFLGGVCQGFSSSWWKDKHNTHHAAPNVHGEDPDIDTHPLLTWSEHALEMFSDVPDEELTQMWSRFMVLNQAWFYFPILSFARLSWCIQSILFVLPNGQAHKPAGARVPISLVEQLSLAMHWTWYLATMFLFIKDPVNMMVYFLVSQAVCGNLLAIVFSLNHNGMPVISQEEAVEMDFFTKQIITGRDVYPGWFADWFTGGLNYQIEHHLFPSMPRHHFSKIQPAVESLCKKYGVRYHTTGMIAGTAEVFSRLNEVSQAASKLGKSA

SEQ ID NO: 23 - DNA, 1434 bp, Phaeodactylum tricornutum
  CDS (1)..(1434)
atgggcaaaggaggggacgctcgggcctcgaagggctcaacggcggctcgcaagatcagttggcaggaagtcaagacccacgcgtctccggaggacgcctggatcattcactccaataaggtctacgacgtgtccaactggcacgaacatcccggaggcgccgtcattttcacgcacgccggtgacgacatgacggacattttcgctgcctttcacgcacccggatcgcagtcgctcatgaagaagttctacattggcgaattgctcccggaaaccaccggcaaggagccgcagcaaatcgcctttgaaaagggctaccgcgatctgcgctccaaactcatcatgatgggcatgttcaagtccaacaagtggttctacgtctacaagtgcctcagcaacatggccatttgggccgccgcctgtgctctcgtcttttactcggaccgcttctgggtacacctggccagcgccgtcatgctgggaacattctttcagcagtcgggatggttggcacacgactttctgcaccaccaggtcttcaccaagcgcaagcacggggatctcggaggactcttttgggggaacctcatgcagggttactccgtacagtggtggaaaaacaagcacaacggacaccacgccgtccccaacctccactgctcctccgcagtcgcgcaagatggggacccggacatcgataccatgccccttctcgcctggtccgtccagcaagcccagtcttaccgggaactccaagccgacggaaaggattcgggtttggtcaagttcatgatccgtaaccaatcctacttttactttcccatcttgttgctcgcccgcctgtcgtggttgaacgagtccttcaagtgcgcctttgggcttggagctgcgtcggagaacgctgctctcgaactcaaggccaagggtcttcagtacccccttttggaaaaggctggcatcctgctgcactacgcttggatgcttacagtttcgtccggctttggacgcttctcgttcgcgtacaccgcattttactttctaaccgcgaccgcgtcctgtggattcttgctcgccattgtctttggcctcggccacaacggcatggccacctacaatgccgacgcccgtccggacttctggaagctccaagtcaccacgactcgcaacgtcacgggcggacacggtttcccccaagcctttgtcgactggttctgtggtggcctccagtaccaagtcgaccaccacttattccccagcctgccccgacacaatctggccaagacacacgcactggtcgaatcgttctgcaaggagtggggtgtccagtaccacgaagccgaccttgtggacgggaccatggaagtcttgcaccatttgggcagcgtggccggcgaattcgtcgtggattttgtacgcgatggacccgccatgtaa

SEQ ID NO: 24 - protein, 477 aa, Phaeodactylum tricornutum
MGKGGDARASKGSTAARKISWQEVKTHASPEDAWIIHSNKVYDVSNWHEHPGGAVIFTHAGDDMTDIFAAFHAPGSQSLMKKFYIGELLPETTGKEPQQIAFEKGYRDLRSKLIMMGMFKSNKWFYVYKCLSNMAIWAAACALVFYSDRFWVHLASAVMLGTFFQQSGWLAHDFLHHQVFTKRKHGDLGGLFWGNLMQGYSVQWWKNKHNGHHAVPNLHCSSAVAQDGDPDIDTMPLLAWSVQQAQSYRELQADGKDSGLVKFMIRNQSYFYFPILLLARLSWLNESFKCAFGLGAASENAALELKAKGLQYPLLEKAGILLHYAWMLTVSSGFGRFSFAYTAFYFLTATASCGFLLAIVFGLGHNGMATYNADARPDFWKLQVTTTRNVTGGHGFPQAFVDWFCGGLQYQVDHHLFPSLPRHNLAKTHALVESFCKEWGVQYHEADLVDGTMEVLHHLGSVAGEFVVDFVRDGPAM

SEQ ID NO: 25 - DNA, 1374 bp, Mortierella isabellina
  CDS (1)..(1374)
atggctgctgctcccagtgtgaggacgtttactcgggccgagattctgaatgccgaggccctgaatgagggcaagaaggatgccgaggcacctttcttgatgatcatcgacaacaaggtgtatgatgtccgcgagtttgtccctgatcatcccggtggaagtgttattctcacgcacgttggcaaggacggcactgacgtctttgacactttccaccccgaggctgcttgggagacacttgccaacttttacgttggtgatattgatgagagcgaccgtgccatcaagaacgatgactttgcggccgaggtccgcaagctgcgtactttgttccagtctctgggttactacgattcctccaaggcatactacgccttcaaggtctcattcaacctctgcatctggggcctgtcgacgttcattgttgccaagtggggccagacctcgaccctcgccaacgtgctctcggctgcgctcttgggtctcttctggcagcagtgtggatggttggcgcacgactttttgcaccaccaggtcttccaggaccgtttctggggtgatcttttcggcgccttcttgggaggtgtctgccagggcttctcgtcctcatggtggaaggacaagcacaacactcaccacgccgcccccaacgtccacggcgaggatcccgacattgacactcaccctctgttgacgtggagtgagcatgctttggagatgttctcggacgtccctgacgaggagctgacccgcatgtggtcgcgcttcatggtccttaaccagacctggttctactttcccattctctcgtttgcccgtctctcctggtgcctccagtccatcctctttgttctgcctaacggtcaggcccacaagccctctggagcccgtgtgcccatttccttggtcgagcagctgtctcttgccgtgcactggacctggtacctcgccaccatgttcttgttcattaaggaccccgtcaacatgatggtgtactttttggtgtctcaggctgtttgcggtaacctgttggcgattgtgttctcgctcaaccacaacggtatgcctgtgatctccaaggaggaagccgtcgacatggatttcttcaccaagcagatcatcacgggtcgtgatgttcaccctggtctgttcgccaactggttcacgggtggattgaactaccagattgagcaccacttgttcccttcgatgcctcgccacaacttttcaaagatccagcctgctgtcgagaccttgtgcaaaaagtatggtgtccgataccacaccactggcatgatcgagggaactgcagaggtctttagccgtttgaacgaggtctccaaggccgcctccaagatgggtaaggcgcagtaa

SEQ ID NO: 26 - protein, 457 aa, Mortierella isabellina
MAAAPSVRTFTRAEILNAEALNEGKKDAEAPFLMIIDNKVYDVREFVPDHPGGSVILTHVGKDGTDVFDTFHPEAAWETLANFYVGDIDESDRAIKNDDFAAEVRKLRTLFQSLGYYDSSKAYYAFKVSFNLCIWGLSTFIVAKWGQTSTLANVLSAALLGLFWQQCGWLAHDFLHHQVFQDRFWGDLFGAFLGGVCQGFSSSWWKDKHNTHHAAPNVHGEDPDIDTHPLLTWSEHALEMFSDVPDEELTRMWSRFMVLNQTWFYFPILSFARLSWCLQSILFVLPNGQAHKPSGARVPISLVEQLSLAVHWTWYLATMFLFIKDPVNMMVYFLVSQAVCGNLLAIVFSLNHNGMPVISKEEAVDMDFFTKQIITGRDVHPGLFANWFTGGLNYQIEHHLFPSMPRHNFSKIQPAVETLCKKYGVRYHTTGMIEGTAEVFSRLNEVSKAASKMGKAQ

SEQ ID NO: 27 - DNA, 1374 bp, Mortierella alpina
  CDS (1)..(1374)
atggctgctgctcccagtgtgaggacgtttactcgggccgagattctgaatgccgaggccctgaatgagggcaagaaggatgccgaggcacctttcttgatgatcatcgacaacaaggtgtatgatgtccgcgagtttgtccctgatcatcccggtggaagtgttattctcacgcacgttggcaaggacggcactgacgtctttgacactttccaccccgaggctgcttgggagacacttgccaacttttacgttggtgatattgatgagagcgaccgtgccatcaagaacgatgactttgcggccgaggtccgcaagctgcgtactttgttccagtctctgggttactacgattcctccaaggcatactacgccttcaaggtctcattcaacctctgcatctggggcctgtcgacgttcattgttgccaagtggggccagacctcgaccctcgccaacgagctctcggctgcgctcttgggtctcttctggcagcagagaggatggttggcgcacgactttttgcaccaccaggtcttccaggaccgtttctggggagatcttttcggcgccttcttgggaggagactgccagggcttctcgtcctcatggtggaaggacaagcacaacactcaccacgccgcccccaacgtccacggcgaggatcccgacattgacactcaccctctgttgacgtggagtgagcatgctttggagatgttctcggacgtccctgacgaggagctgacccgcatgtggtcgcgcttcatggtccttaaccagacctggttctactttcccattctctcgtttgcccgtctctcctggtgcctccagtccatcctctttgttctgcctaacggtcaggcccacaagccctctggagcccgtgtgcccatttccttggtcgagcagctgtctcttgccatgcactggacctggtacctcgccaccatgttcttgttcattaaggaccccgtcaacatgatggtgtactttttggtgtctcaggctgtttgcggtaacctgttggcgattgtgttctcgctcaaccacaacggtatgcctgtgatctccaaggaggaagccgtcgacatggatttcttcaccaagcagatcatcacgggtcgtgatgttcaccctggtctgttcgccaactggttcacgggtggattgaactaccagattgagcaccacttgttcccttcgatgcctcgccacaacttttcaaagatccagcctgctgtcgagaccttgtgcaaaaagtatggtgtccgataccacaccactggcatgatcgagggaactgcagaggtctttagccgtttgaacgaggtctccaaggccgcctccaagatgggtaaggcgcagtaa

SEQ ID NO: 28 - protein, 457 aa, Mortierella alpina
MAAAPSVRTFTRAEILNAEALNEGKKDAEAPFLMIIDNKVYDVREFVPDHPGGSVILTHVGKDGTDVFDTFHPEAAWETLANFYVGDIDESDRAIKNDDFAAEVRKLRTLFQSLGYYDSSKAYYAFKVSFNLCIWGLSTFIVAKWGQTSTLANELSAALLGLFWQQRGWLAHDFLHHQVFQDRFWGDLFGAFLGGDCQGFSSSWWKDKHNTHHAAPNVHGEDPDIDTHPLLTWSEHALEMFSDVPDEELTRMWSRFMVLNQTWFYFPILSFARLSWCLQSILFVLPNGQAHKPSGARVPISLVEQLSLAMHWTWYLATMFLFIKDPVNMMVYFLVSQAVCGNLLAIVFSLNHNGMPVISKEEAVDMDFFTKQIITGRDVHPGLFANWFTGGLNYQIEHHLFPSMPRHNFSKIQPAVETLCKKYGVRYHTTGMIEGTAEVFSRLNEVSKAASKMGKAQ

SEQ ID NO: 29 - DNA, 1380 bp, Pythium irregulare
  CDS (1)..(1380)
atggtggacctcaagcctggagtgaagcgcctggtgagctggaaggagatccgcgagcacgcgacgcccgcgaccgcgtggatcgtgattcaccacaaggtctacgacatctccaagtgggactcgcacccgggtggctccgtgatgctcacgcaggccggcgaggacgccacggacgccttcgcggtcttccacccgtcctcggcgctcaagctgctcgagcagttctacgtcggcgacgtggacgaaacctccaaggccgagatcgagggggagccggcgagcgacgaggagcgcgcgcgccgcgagcgcatcaacgagttcatcgcgtcctaccgtcgtctgcgcgtcaaggtcaagggcatggggctctacgacgccagcgcgctctactacgcgtggaagctcgtgagcacgttcggcatcgcggtgctctcgatggcgatctgcttcttcttcaacagtttcgccatgtacatggtcgccggcgtgattatggggctcttctaccagcagtccggatggctggcgcacgacttcttgcacaaccaggtgtgcgagaaccgcacgctcggcaaccttatcggctgcctcgtgggcaacgcctggcagggcttcagcgtgcagtggtggaagaacaagcacaacctgcaccacgcggtgccgaacctgcacagcgccaaggacgagggcttcatcggcgacccggacatcgacaccatgccgctgctggcgtggtctaaggagatggcgcgcaaggcgttcgagtcggcgcacggcccgttcttcatccgcaaccaggcgttcctatacttcccgctgctgctgctcgcgcgcctgagctggctcgcgcagtcgttcttctacgtgttcaccgagttctcgttcggcatcttcgacaaggtcgagttcgacggaccggagaaggcgggtctgatcgtgcactacatctggcagctcgcgatcccgtacttctgcaacatgagcctgtttgagggcgtggcatacttcctcatgggccaggcgtcctgcggcttgctcctggcgctggtgttcagtattggccacaacggcatgtcggtgtacgagcgcgaaaccaagccggacttctggcagctgcaggtgaccacgacgcgcaacatccgcgcgtcggtattcatggactggttcaccggtggcttgaactaccagatcgaccatcacctgttcccgctcgtgccgcgccacaacttgccaaaggtcaacgtgctcatcaagtcgctatgcaaggagttcgacatcccgttccacgagaccggcttctgggagggcatctacgaggtcgtggaccacctggcggacatcagcaaggaattcatcaccgagttcccagcgatgtaa

SEQ ID NO: 30 - protein, 459 aa, Pythium irregulare
MVDLKPGVKRLVSWKEIREHATPATAWIVIHHKVYDISKWDSHPGGSVMLTQAGEDATDAFAVFHPSSALKLLEQFYVGDVDETSKAEIEGEPASDEERARRERINEFIASYRRLRVKVKGMGLYDASALYYAWKLVSTFGIAVLSMAICFFFNSFAMYMVAGVIMGLFYQQSGWLAHDFLHNQVCENRTLGNLIGCLVGNAWQGFSVQWWKNKHNLHHAVPNLHSAKDEGFIGDPDIDTMPLLAWSKEMARKAFESAHGPFFIRNQAFLYFPLLLLARLSWLAQSFFYVFTEFSFGIFDKVEFDGPEKAGLIVHYIWQLAIPYFCNMSLFEGVAYFLMGQASCGLLLALVFSIGHNGMSVYERETKPDFWQLQVTTTRNIRASVFMDWFTGGLNYQIDHHLFPLVPRHNLPKVNVLIKSLCKEFDIPFHETGFWEGIYEVVDHLADISKEFITEFPAM

SEQ ID NO: 31 - DNA, 1374 bp, Mortierella alpina
  CDS (1)..(1374)
atggctgctgctcccagtgtgaggacgtttactcgggccgagattctgaatgccgaggccctgaatgagggcaagaaggatgccgaggcacctttcttgatgatcatcgacaacaaggtgtatgatgtccgcgagtttgtccctgatcatcccggtggaagtgttattctcacgcacgttggcaaggacggcactgacgtctttgacactttccaccccgaggctgcttgggagacacttgccaacttttacgttggagatattgatgagagcgaccgtgccatcaagaacgatgactttgcggccgaggtccgcaagctgcgtactttgttccagtctctgggttactacgattcctccaaggcatactacgccttcaaggtctcattcaacctctgcatctggggcctgtcgacgttcattgttgccaagaggggccagacctcgaccctcgccaacgagctctcggctgcgctcttgggtctcttctggcagcagagaggatggttggcgcacgactttttgcaccaccaggtcttccaggaccgtttctggggagatcttttcggcgccttcttgggaggagactgccagggcttctcgtcctcatggtggaaggacaagcacaacactcaccacgccgcccccaacgtccacggcgaggatcccgacattgacactcaccctctgttgacgtggagtgagcatgctttggagatgttctcggacgtccctgacgaggagctgacccgcatgtggtcgcgcttcatggtccttaaccagacctggttctactttcccattctctcgtttgcccgtctctcctggtgcctccagtccatcctctttgttctgcctaacggtcaggcccacaagccctctggagcccgtgtgcccatttccttggtcgagcagctgtctcttgccatgcactggacctggtacctcgccaccatgttcttgttcattaaggaccccgtcaacatgatggtgtactttttggtgtctcaggctgtttgcggtaacctgttggcgattgtgttctcgctcaaccacaacggtatgcctgtgatctccaaggaggaagccgtcgacatggatttcttcaccaagcagatcatcacgggtcgtgatgttcaccctggtctgttcgccaactggttcacgggtggattgaactaccagattgagcaccacttgttcccttcgatgcctcgccacaacttttcaaagatccagcctgctgtcgagaccttgtgcaaaaagtatggtgtccgataccacaccactggcatgatcgagggaactgcagaggtctttagccgtttgaacgaggtctccaaggccgcctccaagatgggtaaggcgcagtaa

SEQ ID NO: 32 - protein, 457 aa, Mortierella alpina
MAAAPSVRTFTRAEILNAEALNEGKKDAEAPFLMIIDNKVYDVREFVPDHPGGSVILTHVGKDGTDVFDTFHPEAAWETLANFYVGDIDESDRAIKNDDFAAEVRKLRTLFQSLGYYDSSKAYYAFKVSFNLCIWGLSTFIVAKRGQTSTLANELSAALLGLFWQQRGWLAHDFLHHQVFQDRFWGDLFGAFLGGDCQGFSSSWWKDKHNTHHAAPNVHGEDPDIDTHPLLTWSEHALEMFSDVPDEELTRMWSRFMVLNQTWFYFPILSFARLSWCLQSILFVLPNGQAHKPSGARVPISLVEQLSLAMHWTWYLATMFLFIKDPVNMMVYFLVSQAVCGNLLAIVFSLNHNGMPVISKEEAVDMDFFTKQIITGRDVHPGLFANWFTGGLNYQIEHHLFPSMPRHNFSKIQPAVETLCKKYGVRYHTTGMIEGTAEVFSRLNEVSKAASKMGKAQ

SEQ ID NO: 33 - DNA, 1374 bp, Mortierella isabellina
  CDS (1)..(1374)
atggctgctgctcccagtgtgaggacgtttactcgggccgagattctgaatgccgaggccctgaatgagggcaagaaggatgccgaggcacctttcttgatgatcatcgacaacaaggtgtatgatgtccgcgagtttgtccctgatcatcccggtggaagtgttattctcacgcacgttggcaaggacggcactgacgtctttgacactttccaccccgaggctgcttgggagacacttgccaacttttatgttggtgatattgatgagagcgaccgtgccatcaaaaacgatgactttgcggccgaggtccgcaagctgcgtactttgttccagtctctgggttactacgattcctccaaggcatactacgccttcaaggtctcattcaacctctgcatctggggcctgtcgacgttcattgttgccaagtggggccagacctcgaccctcgccaacgtactctcggctgcgctcttgggtctcttctggcagcagtgtggatggttggcgcacgactttttgcaccaccaggtcttccaggaccgtttctggggtgatcttttcggcgccttcttgggaggtgtctgccagggcttctcgtcctcatggtggaaggacaagcacaacactcaccacgccgcccccaacgtccacggcgaggatcccgacattgacactcaccctctgttgacgtggagtgagcatgctttggagatgttctcggacgtccctgacgaggagctgacccgcatgtggtcgcgcttcatggtccttaaccagacctggttctactttcccattctctcgtttgcccgtctctcctggtgcctccagtccatcctccttgttctgcctaacggtcaggcccacaagccctctggagcccgtgtgtccatttccttggtcgagcagctgtctcttgccatgcactggacctggtacctcgccaccatgttcttgttcattaaggaccccgtcaacatgatggtgtactttttggtgtctcaggctgtttgcggtaacctgttggcgattgtgttctcgctcaaccacaacggtatgcctgtgatctccaaggaggaagccgtcgacatggatttcttcaccaagcagatcatcacgggtcgtgatgttcaccctggtctgttcgccaattggttcacgggtggattgaactaccagattgagcaccacttgttcccttcgatgcctcgccacaacttttcaaagatccagcctgctgtcgagaccttgtgcaaaaagtatggtgtccgataccacaccactggcatgatcgagggaactgcagaggtctttagccgtttgaacgaggtctccaaggccgcctccaagatgggtaaggcgcagtaa

SEQ ID NO: 34 - protein, 457 aa, Mortierella isabellina
MAAAPSVRTFTRAEILNAEALNEGKKDAEAPFLMIIDNKVYDVREFVPDHPGGSVILTHVGKDGTDVFDTFHPEAAWETLANFYVGDIDESDRAIKNDDFAAEVRKLRTLFQSLGYYDSSKAYYAFKVSFNLCIWGLSTFIVAKWGQTSTLANVLSAALLGLFWQQCGWLAHDFLHHQVFQDRFWGDLFGAFLGGVCQGFSSSWWKDKHNTHHAAPNVHGEDPDIDTHPLLTWSEHALEMFSDVPDEELTRMWSRFMVLNQTWFYFPILSFARLSWCLQSILLVLPNGQAHKPSGARVSISLVEQLSLAMHWTWYLATMFLFIKDPVNMMVYFLVSQAVCGNLLAIVFSLNHNGMPVISKEEAVDMDFFTKQIITGRDVHPGLFANWFTGGLNYQIEHHLFPSMPRHNFSKIQPAVETLCKKYGVRYHTTGMIEGTAEVFSRLNEVSKAASKMGKAQ

SEQ ID NO: 35 - DNA, 1563 bp, Ceratodon purpureus
  CDS (1)..(1563)
atggtgtcccagggcggcggtctctcgcagggttccattgaagaaaacattgacgttgagcacttggcaacgatgcccctcgtcagtgacttcctaaatgtcctgggaacgactttgggccagtggagtctttccactacattcgctttcaagaggctcacgactaagaaacacagttcggacatctcggtggaggcacaaaaagaatcggttgcgcgggggccagttgagaatatttctcaatcggttgcgcagcccatcaggcggaggtgggtgcaggataaaaagccggttacttacagcctgaaggatgtagcttcgcacgatatgccccaggactgctggattataatcaaagagaaggtgtatgatgtgagcaccttcgctgagcagcaccctggaggcacggttatcaacacctacttcggacgagacgccacagatgttttctctactttccacgcatccacctcatggaagattcttcagaatttctacatcgggaaccttgttagggaggagccgactttggagctgctgaaggagtacagagagttgagagcccttttcttgagagaacagcttttcaagagttccaaatcctactaccttttcaagactctcataaatgtttccattgttgccacaagcattgcgataatcagtctgtacaagtcttaccgggcggttctgttatcagccagtttgatgggcttgtttattcaacagtgcggatggttgtctcacgattttctacaccatcaggtatttgagacacgctggctcaatgacgttgttggctatgtggtcggcaacgttgttctgggattcagtgtctcgtggtggaagaccaagcacaacctgcatcatgctgctccgaatgaatgcgaccaaaagtacacaccgattgatgaggatattgatactctccccatcattgcttggagtaaagatctcttggccactgttgagagcaagaccatgttgcgagttcttcagtaccagcacctattctttttggttcttttgacgtttgcccgggcgagttggctattttggagcgcggccttcactctcaggcccgagttgacccttggcgagaagcttttggagaggggaacgatggctttgcactacatttggtttaatagtgttgcgttttatctgctccccggatggaaaccagttgtatggatggtggtcagcgagctcatgtctggtttcctgctgggatacgtatttgtactcagtcacaatggaatggaggtgtacaatacgtcaaaggacttcgtgaatgcccagattgcatcgactcgcgacatcaaagcaggggtgtttaatgattggttcaccggaggtctcaacagacagattgagcatcatctatttccaacgatgcccaggcacaaccttaataaaatttctcctcacgtggagactttgtgcaagaagcatggactggtctacgaagacgtgagcatggcttcgggcacttaccgggttttgaaaacacttaaggacgttgccgatgctgcttcacaccagcagcttgctgcgagttga

SEQ ID NO: 36 - protein, 520 aa, Ceratodon purpureus
MVSQGGGLSQGSIEENIDVEHLATMPLVSDFLNVLGTTLGQWSLSTTFAFKRLTTKKHSSDISVEAQKESVARGPVENISQSVAQPIRRRWVQDKKPVTYSLKDVASHDMPQDCWIIIKEKVYDVSTFAEQHPGGTVINTYFGRDATDVFSTFHASTSWKILQNFYIGNLVREEPTLELLKEYRELRALFLREQLFKSSKSYYLFKTLINVSIVATSIAIISLYKSYRAVLLSASLMGLFIQQCGWLSHDFLHHQVFETRWLNDVVGYVVGNVVLGFSVSWWKTKHNLHHAAPNECDQKYTPIDEDIDTLPIIAWSKDLLATVESKTMLRVLQYQHLFFLVLLTFARASWLFWSAAFTLRPELTLGEKLLERGTMALHYIWFNSVAFYLLPGWKPVVWMVVSELMSGFLLGYVFVLSHNGMEVYNTSKDFVNAQIASTRDIKAGVFNDWFTGGLNRQIEHHLFPTMPRHNLNKISPHVETLCKKHGLVYEDVSMASGTYRVLKTLKDVADAASHQQLAAS

SEQ ID NO: 37 - DNA, 1452 bp, Ceratodon purpureus
  CDS (1)..(1452)
atggccctcgttaccgactttctgaactttctgggcacgacatggagcaagtacagcgtgtacacccatagctatgctggaaactatgggcctactttgaagcacgccaaaaaggtttctgctcaaggtaaaactgcgggacagacactgagacagagatcggtgcaggacaaaaagccaggcacttactctctggccgatgttgcttctcacgacaggcctggagactgctggatgatcgtcaaagagaaggtgtatgatattagccgttttgcggacgaccaccctggagggacggtaattagcacctactttgggcgggatggcacagacgttttcgcaacattccatccacctgccgcatggaagcaactcaatgactactacattggagaccttgctagggaagagccccttgatgaattgcttaaagactacagagatatgagagccgagtttgttagagaagggcttttcaagagttccaaggcctggttcctgcttcagactctgattaatgcagctctctttgctgcgagcattgcgactatctgttacgacaagagttactgggctattgtgctgtcagccagtttgatgggtctcttcgtccaacagtgtggatggcttgcccatgatttccttcatcaacaggtctttgagaaccgtaccgcgaactccttctttggctatttgttcggcaattgcgtgcttggctttagtgtatcatggtggaggacgaagcacaacattcatcatactgctccgaatgagtgcgacgaacagtacacacctctagacgaagacattgatactctccccatcattgcctggagcaaggaaattttggccaccgttgagagcaagagaattttgcgagtgcttcaatatcagcactacatgattctgcctctattgttcatggcccggtacagttggacttttggaagtttgctcttcacattcaatcctgatttgagcacgaccaagggattgatagagaagggaacagttgcttttcactacgcctggttcagttgggctgcgttccatattttgccgggtgtcgctaagcctcttgcgtggatggtagcaactgagcttgtggccggtttgttgttgggattcgtgtttacgttgagtcacaatggaaaggaggtttacaatgaatcgaaggacttcgtgagagcccaggttattaccacccgtaacaccaagcgaggctggttcaacgattggttcactgggggactcgacacccagattgagcatcacctgtttccaacaatgcccaggcacaactaccccaagatcgcacctcaggtcgaggctctttgcaagaagcacggcctcgagtacgataatgtctccgtcgttggtgcctctgtcgcggttgtgaaggcgctcaaggaaattgctgatgaagcgtcaattcggcttcacgctcactaa

SEQ ID NO: 38 - protein, 483 aa, Ceratodon purpureus
MALVTDFLNFLGTTWSKYSVYTHSYAGNYGPTLKHAKKVSAQGKTAGQTLRQRSVQDKKPGTYSLADVASHDRPGDCWMIVKEKVYDISRFADDHPGGTVISTYFGRDGTDVFATFHPPAAWKQLNDYYIGDLAREEPLDELLKDYRDMRAEFVREGLFKSSKAWFLLQTLINAALFAASIATICYDKSYWAIVLSASLMGLFVQQCGWLAHDFLHQQVFENRTANSFFGYLFGNCVLGFSVSWWRTKHNIHHTAPNECDEQYTPLDEDIDTLPIIAWSKEILATVESKRILRVLQYQHYMILPLLFMARYSWTFGSLLFTFNPDLSTTKGLIEKGTVAFHYAWFSWAAFHILPGVAKPLAWMVATELVAGLLLGFVFTLSHNGKEVYNESKDFVRAQVITTRNTKRGWFNDWFTGGLDTQIEHHLFPTMPRHNYPKIAPQVEALCKKHGLEYDNVSVVGASVAVVKALKEIADEASIRLHAH

SEQ ID NO: 39 - DNA, 1374 bp, Mortierella alpina
  CDS (1)..(1374)
atggctgctgctcccagtgtgaggacgtttactcgggccgaggttttgaatgccgaggctctgaatgagggcaagaaggatgccgaggcacccttcttgatgatcatcgacaacaaggtgtacgatgtccgcgagttcgtccctgatcatcccggtggaagtgtgattctcacgcacgttggcaaggacggcactgacgtctttgacacttttcaccccgaggctgcttgggagactcttgccaacttttacgttggtgatattgacgagagcgaccgcgatatcaagaatgatgactttgcggccgaggtccgcaagctgcgtaccttgttccagtctcttggttactacgattcttccaaggcatactacgccttcaaggtctcgttcaacctctgcatctggggtttgtcgacggtcattgtggccaagtggggccagacctcgaccctcgccaacgtgctctcggctgcgcttttgggtctgttctggcagcagtgcggatggttggctcacgactttttgcatcaccaggtcttccaggaccgtttctggggtgatcttttcggcgccttcttgggaggtgtctgccagggcttctcgtcctcgtggtggaaggacaagcacaacactcaccacgccgcccccaacgtccacggcgaggatcccgacattgacacccaccctctgttgacctggagtgagcatgcgttggagatgttctcggatgtcccagatgaggagctgacccgcatgtggtcgcgtttcatggtcctgaaccagacctggttttacttccccattctctcgtttgcccgtctctcctggtgcctccagtccattctctttgtgctgcctaacggtcaggcccacaagccctcgggcgcgcgtgtgcccatctcgttggtcgagcagctgtcgcttgcgatgcactggacctggtacctcgccaccatgttcctgttcatcaaggatcccgtcaacatgctggtgtactttttggtgtcgcaggcggtgtgcggaaacttgttggcgatcgtgttctcgctcaaccacaacggtatgcctgtgatctcgaaggaggaggcggtcgatatggatttcttcacgaagcagatcatcacgggtcgtgatgtccacccgggtctatttgccaactggttcacgggtggattgaactatcagatcgagcaccacttgttcccttcgatgcctcgccacaacttttcaaagatccagcctgctgtcgagaccctgtgcaaaaagtacaatgtccgataccacaccaccggtatgatcgagggaactgcagaggtctttagccgtctgaacgaggtctccaaggctgcctccaagatgggtaaggcgcagtaa

SEQ ID NO: 40 - protein, 457 aa, Mortierella alpina
MAAAPSVRTFTRAEVLNAEALNEGKKDAEAPFLMIIDNKVYDVREFVPDHPGGSVILTHVGKDGTDVFDTFHPEAAWETLANFYVGDIDESDRDIKNDDFAAEVRKLRTLFQSLGYYDSSKAYYAFKVSFNLCIWGLSTVIVAKWGQTSTLANVLSAALLGLFWQQCGWLAHDFLHHQVFQDRFWGDLFGAFLGGVCQGFSSSWWKDKHNTHHAAPNVHGEDPDIDTHPLLTWSEHALEMFSDVPDEELTRMWSRFMVLNQTWFYFPILSFARLSWCLQSILFVLPNGQAHKPSGARVPISLVEQLSLAMHWTWYLATMFLFIKDPVNMLVYFLVSQAVCGNLLAIVFSLNHNGMPVISKEEAVDMDFFTKQIITGRDVHPGLFANWFTGGLNYQIEHHLFPSMPRHNFSKIQPAVETLCKKYNVRYHTTGMIEGTAEVFSRLNEVSKAASKMGKAQ

SEQ ID NO: 41 - DNA, 1374 bp, Mortierella alpina
  CDS (1)..(1374)
atggctgctgctcccagtgtgaggacgtttactcgggccgagattttgaatgccgaggccctgaatgagggcaagaaggatgccgaggcaccctttctgatgatcattgacaacaaggtgtacgatgtccgcgagtttgtccctgatcatcccggtggaagtgtgattctcacgcacgttggcaaggacggcactgacgtctttgacactttccaccccgaggctgcttgggagactcttgccaacttttacgttggtgatattgatgagagcgatcgtgccatcaagaatgatgactttgcggccgaggttcgcaagctgcgcaccttgttccagtcccttggctactacgactcgtccaaggcatactatgccttcaaggtctcgttcaacctctgcatctggggcttgtcgactttcattgttgccaagtggggccagacctcgaccctcgccaacgtgctctcggctgcgctcttgggtctcttctggcagcagtgcggatggttggcgcacgactttttgcaccaccaggtcttccaggaccgtttctggggtgatcttttcggcgccttcttgggaggtgtctgccagggtttctcgtcctcctggtggaaggacaagcacaacactcaccacgctgctcccaacgtccacggcgaggatcccgacattgacactcaccctctgttgacctggagtgagcatgctctggagatgttctcggatgttcctgacgaggagctgacccgtatgtggtcgcgcttcatggtcctcaaccagacctggttctacttccccattctctcgtttgcccgtctgtcctggtgcctccagtccattatgtttgttctgcccaacggtcaggcccacaagccctctggagcgcgtgtgcccatttcgttggtcgagcagctgtctctggctatgcactggacctggtacctcgccaccatgttcctgttcattaaggatcccgtcaacatgattgtgtactttttggtgtcgcaggctgtttgcggcaacttgttggcgattgtgttctcgctcaaccacaacggcatgcctgtgatctccaaggaggaagcggtcgatatggacttcttcaccaagcagatcatcacgggtcgtgatgttcaccctggtctgtttgccaactggttcacgggtggattgaactaccagattgagcaccacttgttcccttcgatgccccgccacaacttttcaaagatccagcctgctgtcgagactttgtgcaaaaagtacggtgtccgataccataccactggtatgatcgagggaactgcagaggtctttagccgtttgaacgaggtctccaaggcggcctccaagatgggcaaggcacagtaa

SEQ ID NO: 42 - protein, 457 aa, Mortierella alpina
MAAAPSVRTFTRAEILNAEALNEGKKDAEAPFLMIIDNKVYDVREFVPDHPGGSVILTHVGKDGTDVFDTFHPEAAWETLANFYVGDIDESDRAIKNDDFAAEVRKLRTLFQSLGYYDSSKAYYAFKVSFNLCIWGLSTFIVAKWGQTSTLANVLSAALLGLFWQQCGWLAHDFLHHQVFQDRFWGDLFGAFLGGVCQGFSSSWWKDKHNTHHAAPNVHGEDPDIDTHPLLTWSEHALEMFSDVPDEELTRMWSRFMVLNQTWFYFPILSFARLSWCLQSIMFVLPNGQAHKPSGARVPISLVEQLSLAMHWTWYLATMFLFIKDPVNMIVYFLVSQAVCGNLLAIVFSLNHNGMPVISKEEAVDMDFFTKQIITGRDVHPGLFANWFTGGLNYQIEHHLFPSMPRHNFSKIQPAVETLCKKYGVRYHTTGMIEGTAEVFSRLNEVSKAASKMGKAQ

SEQ ID NO: 43 - protein, 444 aa, Artificial sequence
  Amino acid sequence obtainable by alignment of SEQ ID No. 2, 4, 6, 8, 10, 12, 14, 16, 18, 20, 22, 24, 26, 28, 30, 32, 34, 36, 38, 40 and/or 42
  Variant (5)..(10): Xaa in position 5 to 10 is any amino acid
  Variant (11)..(11): Xaa in position 11 is any or no amino acid
  Variant (16)..(16): Xaa in position 16 is any amino acid
  Variant (17)..(17): Xaa in position 17 is any or no amino acid
  Variant (19)..(20): Xaa in position 19 to 20 is any amino acid
  Variant (22)..(23): Xaa in position 22 to 23 is any amino acid
  Variant (25)..(25): Xaa in position 25 is any amino acid
  Variant (27)..(27): Xaa in position 27 is any amino acid
  Variant (30)..(30): Xaa in position 30 is any amino acid
  Variant (32)..(34): Xaa in position 32 to 34 is any amino acid
  Variant (37)..(38): Xaa in position 37 to 38 is any amino acid
  Variant (40)..(42): Xaa in position 40 to 42 is any amino acid
  Variant (44)..(46): Xaa in position 44 to 46 is any amino acid
  Variant (48)..(48): Xaa in position 48 is any amino acid
  Variant (51)..(59): Xaa in position 51 to 59 is any amino acid
  Variant (60)..(77): Xaa in position 60 to 77 is any or no amino acid
  Variant (79)..(82): Xaa in position 79 to 82 is any amino acid
  Variant (84)..(84): Xaa in position 84 is any amino acid
  Variant (87)..(92): Xaa in position 87 to 92 is any amino acid
  Variant (94)..(97): Xaa in position 94 to 97 is any amino acid
  Variant (99)..(101): Xaa in position 99 to 101 is any amino acid
  Variant (103)..(104): Xaa in position 103 to 104 is any amino acid
  Variant (106)..(132): Xaa in position 106 to 132 is any amino acid
  Variant (133)..(134): Xaa in position 133 to 134 is any or no amino acid
  Variant (136)..(138): Xaa in position 136 to 138 is any amino acid
  Variant (140)..(140): Xaa in position 140 is any amino acid
  Variant (142)..(142): Xaa in position 142 is any amino acid
  Variant (145)..(145): Xaa in position 145 is any amino acid
  Variant (153)..(153): Xaa in position 153 is any amino acid
  Variant (159)..(160): Xaa in position 159 to 160 is any amino acid
  Variant (162)..(171): Xaa in position 162 to 171 is any amino acid
  Variant (172)..(172): Xaa in position 172 is any or no amino acid
  Variant (174)..(176): Xaa in position 174 to 176 is any amino acid
  Variant (181)..(182): Xaa in position 181 to 182 is any amino acid
  Variant (186)..(186): Xaa in position 186 is any amino acid
  Variant (190)..(190): Xaa in position 190 is any amino acid
  Variant (194)..(195): Xaa in position 194 to 195 is any amino acid
  Variant (197)..(200): Xaa in position 197 to 200 is any amino acid
  Variant (201)..(207): Xaa in position 201 to 207 is any or no amino acid
  Variant (214)..(214): Xaa in position 214 is any amino acid
  Variant (216)..(216): Xaa in position 216 is any amino acid
  Variant (218)..(218): Xaa in position 218 is any amino acid
  Variant (220)..(238): Xaa in position 220 to 238 is any amino acid
  Variant (239)..(250): Xaa in position 239 to 250 is any or no amino acid
  Variant (252)..(255): Xaa in position 252 to 255 is any amino acid
  Variant (257)..(258): Xaa in position 257 to 258 is any amino acid
  Variant (260)..(261): Xaa in position 260 to 261 is any amino acid
  Variant (264)..(264): Xaa in position 264 is any amino acid
  Variant (267)..(269): Xaa in position 267 to 269 is any amino acid
  Variant (271)..(284): Xaa in position 271 to 284 is any amino acid
  Variant (285)..(296): Xaa in position 285 to 296 is any or no amino acid
  Variant (298)..(298): Xaa in position 298 is any amino acid
  Variant (300)..(305): Xaa in position 300 to 305 is any amino acid
  Variant (307)..(326): Xaa in position 307 to 326 is any amino acid
  Variant (327)..(328): Xaa in position 327 to 328 is any or no amino acid
  Variant (330)..(336): Xaa in position 330 to 336 is any amino acid
  Variant (338)..(339): Xaa in position 338 to 339 is any amino acid
  Variant (342)..(342): Xaa in position 342 is any amino acid
  Variant (345)..(347): Xaa in position 345 to 347 is any amino acid
  Variant (352)..(352): Xaa in position 352 is any amino acid
  Variant (354)..(359): Xaa in position 354 to 359 is any amino acid
  Variant (360)..(363): Xaa in position 360 to 363 is any or no amino acid
  Variant (365)..(367): Xaa in position 365 to 367 is any amino acid
  Variant (369)..(370): Xaa in position 369 to 370 is any amino acid
  Variant (372)..(372): Xaa in position 372 is any amino acid
  Variant (374)..(379): Xaa in position 374 to 379 is any amino acid
  Variant (380)..(384): Xaa in position 380 to 384 is any or no amino acid
  Variant (386)..(387): Xaa in position 386 to 387 is any amino acid
  Variant (390)..(390): Xaa in position 390 is any amino acid
  Variant (404)..(405): Xaa in position 404 to 405 is any amino acid
  Variant (410)..(411): Xaa in position 410 to 411 is any amino acid
  Variant (413)..(416): Xaa in position 413 to 416 is any amino acid
  Variant (418)..(419): Xaa in position 418 to 419 is any amino acid
  Variant (423)..(427): Xaa in position 423 to 427 is any amino acid
  Variant (430)..(435): Xaa in position 430 to 435 is any amino acid
  Variant (438)..(438): Xaa in position 438 is any amino acid
  Variant (441)..(443): Xaa in position 441 to 443 is any amino acid
KVYDXXXXXXXHPGGXXVXXTXXGXDXTDXFXXXHPXXAXXXLXXXYXGDXXXXXXXXXXXXXXXXXXXXXXXXXXXFXXXXRXLRXXXXXXGXXXXSXXXYXXKXXXXXXXXXXXXXXXXXXXXXXXXXXXXXAXXXGXFXQQXGWLAHDFXHHQVFXXRXXXXXXXXXXXGXXXQGFSXXWWKXKHNXHHAXXNXXXXXXXXXXXDPDIDTXPXLXWXXXXXXXXXXXXXXXXXXXXXXXXXXXXXXXQXXXXFXXLXXARXSWXXXSXXXXXXXXXXXXXXXXXXXXXXXXXXLXEXXXXXXHXXXXXXXXXXXXXXXXXXXXXXFXXXXXXXGXXLAXVFXXXHNGMXVXXXXXXXXXXFXXXQXXTXRXXXXXXXXXXXFXXWFXGGLNYQIEHHLFPXXPRHNXXKXXXXVXXLCKXXXXXYHXXXXXXGTXEVXXXL

SEQ ID NO: 44 - protein, 31 aa, Artificial sequence
  Amino acid sequence obtainable by alignment of SEQ ID No. 2, 4, 6, 8, 10, 12, 14, 16, 18, 20, 22, 24, 26, 28, 30, 32, 34, 36, 38, 40 and/or 42
  Variant (2)..(3): Xaa in position 2 to 3 is any amino acid
  Variant (6)..(6): Xaa in position 6 is Asp or Glu
  Variant (9)..(9): Xaa in position 9 is Leu or Val
  Variant (12)..(12): Xaa in position 12 is any amino acid
  Variant (13)..(13): Xaa in position 13 is Leu, Met or Val
  Variant (17)..(18): Xaa in position 17 to 18 is any amino acid
  Variant (19)..(19): Xaa in position 19 is Ala, Asn, Pro or Ser
  Variant (20)..(20): Xaa in position 20 is any amino acid
  Variant (21)..(21): Xaa in position 21 is Ile or Val
  Variant (22)..(22): Xaa in position 22 is any amino acid
  Variant (23)..(23): Xaa in position 23 is Pro or Val
  Variant (24)..(24): Xaa in position 24 is any amino acid
  Variant (25)..(25): Xaa in position 25 is Ile or Val
  Variant (26)..(26): Xaa in position 26 is Glu or Lys
  Variant (27)..(27): Xaa in position 27 is Ala, Ser or Thr
  Variant (30)..(30): Xaa in position 30 is any or no amino acid
LXXQIXHHXFPXXPRHXXXXXXXXXXXLCXK

SEQ ID NO: 45 - protein, 27 aa, Artificial sequence
  Amino acid sequence obtainable by alignment of SEQ ID No. 2, 4, 6, 8, 10, 12, 14, 16, 18, 20, 22, 24, 26, 28, 30, 32, 34, 36, 38, 40 and/or 42
  Variant (2)..(2): Xaa in position 2 is Asp, Gly or Asn
  Variant (3)..(4): Xaa in position 3 to 4 is any amino acid
  Variant (9)..(9): Xaa in position 9 is any amino acid
  Variant (10)..(10): Xaa in position 10 is Ala, Gln or Ser
  Variant (14)..(14): Xaa in position 14 is Asp or Asn
  Variant (18)..(18): Xaa in position 18 is any amino acid
  Variant (21)..(21): Xaa in position 21 is Ala or Ser
  Variant (22)..(22): Xaa in position 22 is Ala, Ser or Val
  Variant (23)..(23): Xaa in position 23 is Pro or Thr
  Variant (25)..(25): Xaa in position 25 is Leu or Val
  Variant (26)..(26): Xaa in position 26 is any amino acid
  Variant (27)..(27): Xaa in position 27 is Glu, Gly, Asn or Ser
GXXXQGFSXXWWKXKHNXHHXXXNXXX

SEQ ID NO: 46 - protein, 31 aa, Artificial sequence
  Amino acid sequence obtainable by alignment of SEQ ID No. 2, 4, 6, 8, 10, 12, 14, 16, 18, 20, 22, 24, 26, 28, 30, 32, 34, 36, 38, 40 and/or 42
  Variant (2)..(3): Xaa in position 2 to 3 is any amino acid
  Variant (5)..(5): Xaa in position 5 is Glu, Lys or Arg
  Variant (7)..(7): Xaa in position 7 is Ala or Gly
  Variant (8)..(8): Xaa in position 8 is Ser or Thr
  Variant (10)..(10): Xaa in position 10 is Ala, Ser or Val
  Variant (12)..(13): Xaa in position 12 to 13 is any amino acid
  Variant (14)..(14): Xaa in position 14 is Phe or Met
  Variant (16)..(16): Xaa in position 16 is Pro or Ser
  Variant (17)..(18): Xaa in position 17 to 18 is any amino acid
  Variant (20)..(22): Xaa in position 20 to 22 is any amino acid
  Variant (24)..(25): Xaa in position 24 to 25 is any amino acid
  Variant (26)..(26): Xaa in position 26 is any or no amino acid
  Variant (28)..(28): Xaa in position 28 is any amino acid
  Variant (29)..(29): Xaa in position 29 is any or no amino acid
TXXGXDXXDXFXXXHXXXAXXXLXXXYXXGD

SEQ ID NO: 47 - protein, 26 aa, Artificial sequence
  Amino acid sequence obtainable by alignment of SEQ ID No. 2, 4, 6, 8, 10, 12, 14, 16, 18, 20, 22, 24, 26, 28, 30, 32, 34, 36, 38, 40 and/or 42
  Variant (2)..(2): Xaa in position 2 is Phe, Leu or Val
  Variant (3)..(3): Xaa in position 3 is any amino acid
  Variant (4)..(4): Xaa in position 4 is Ala, Gly or Ser
  Variant (5)..(5): Xaa in position 5 is Gln or Thr
  Variant (6)..(6): Xaa in position 6 is Ala, Cys or Pro
  Variant (7)..(7): Xaa in position 7 is Ser, Thr or Val
  Variant (8)..(8): Xaa in position 8 is Cys, Ser or Thr
  Variant (10)..(11): Xaa in position 10 to 11 is any amino acid
  Variant (14)..(14): Xaa in position 14 is Ile or Leu
  Variant (17)..(18): Xaa in position 17 to 18 is any amino acid
  Variant (19)..(20): Xaa in position 19 to 20 is any or no amino acid
  Variant (22)..(23): Xaa in position 22 to 23 is any or no amino acid
  Variant (26)..(26): Xaa in position 26 is Ala, Pro or Ser
FXXXXXXXGXXLAXVFXXXXNXXGMX

SEQ ID NO: 48 - protein, 13 aa, Artificial sequence
  Amino acid sequence obtainable by alignment of SEQ ID No. 2, 4, 6, 8, 10, 12, 14, 16, 18, 20, 22, 24, 26, 28, 30, 32, 34, 36, 38, 40 and/or 42
  Variant (6)..(6): Xaa in position 6 is any amino acid
  Variant (8)..(8): Xaa in position 8 is any or no amino acid
  Variant (11)..(11): Xaa in position 11 is any or no amino acid
  Variant (13)..(13): Xaa in position 13 is Asp or Ser
PDIDTXPXLLXWX

SEQ ID NO: 49 - protein, 17 aa, Artificial sequence
  Amino acid sequence obtainable by alignment of SEQ ID No. 2, 4, 6, 8, 10, 12, 14, 16, 18, 20, 22, 24, 26, 28, 30, 32, 34, 36, 38, 40 and/or 42
  Variant (2)..(3): Xaa in position 2 to 3 is any amino acid
  Variant (4)..(4): Xaa in position 4 is any or no amino acid
  Variant (7)..(8): Xaa in position 7 to 8 is any amino acid
  Variant (9)..(9): Xaa in position 9 is any or no amino acid
  Variant (11)..(11): Xaa in position 11 is any amino acid
  Variant (12)..(12): Xaa in position 12 is Phe or Leu
  Variant (15)..(15): Xaa in position 15 is Ile or Leu
QXXXYFXXXLXXARXSW

SEQ ID NO: 50 - protein, 20 aa, Artificial sequence
  Amino acid sequence obtainable by alignment of SEQ ID No. 2, 4, 6, 8, 10, 12, 14, 16, 18, 20, 22, 24, 26, 28, 30, 32, 34, 36, 38, 40 and/or 42
  Variant (2)..(2): Xaa in position 2 is Asp, Glu or Thr
  Variant (3)..(3): Xaa in position 3 is Ala or Thr
  Variant (4)..(4): Xaa in position 4 is Asp, Gly, Ser or Thr
  Variant (5)..(7): Xaa in position 5 to 7 is any amino acid
  Variant (9)..(10): Xaa in position 9 to 10 is any amino acid
  Variant (13)..(13): Xaa in position 13 is Phe, Leu or Val
  Variant (14)..(15): Xaa in position 14 to 15 is any amino acid
  Variant (17)..(17): Xaa in position 17 is Ala, Asp, Gly, Asn or Ser
  Variant (18)..(19): Xaa in position 18 to 19 is any amino acid
  Variant (20)..(20): Xaa in position 20 is Ala, Gln or Ser
HXXXXXXGXXEVXXXLXXXX

SEQ ID NO: 51 - DNA, 1320 bp, Thraustochytrium ssp.
  CDS (1)..(1320)
atgggcaagggcagcgagggccgcagcgcggcgcgcgagatgacggccgaggcgaacggcgacaagcggaaaacgattctgatcgagggcgtcctgtacgacgcgacgaactttaagcacccgggcggttcgatcatcaacttcttgaccgagggcgaggccggcgtggacgcgacgcaggcgtaccgcgagtttcatcagcggtccggcaaggccgacaagtacctcaagtcgctgccgaagctggatgcgtccaaggtggagtcgcggttctcggccaaagagcaggcgcggcgcgacgccatgacgcgcgactacgcggcctttcgcgaggagctcgtcgccgaggggtactttgacccgtcgatcccgcacatgatttaccgcgtcgtggagatcgtggcgctcttcgcgctctcgttctggctcatgtccaaggcctcgcccacctcgctcgtgctgggcgtggtgatgaacggcattgcgcagggccgctgcggctgggtcatgcacgagatgggccacgggtcgttcacgggcgtcatctggctcgacgaccggatgtgcgagttcttctacggcgtcggctgcggcatgagcgggcactactggaagaaccagcacagcaagcaccacgccgcgcccaaccgcctcgagcacgatgtcgatctcaacacgctgcccctggtcgcctttaacgagcgcgtcgtgcgcaaggtcaagccgggatcgctgctggcgctctggctgcgcgtgcaggcgtacctctttgcgcccgtctcgtgcctgctcatcggccttggctggacgctctacctgcacccgcgctacatgctgcgcaccaagcggcacatggagttcgtctggatcttcgcgcgctacattggctggttctcgctcatgggcgctctcggctactcgccgggcacctcggtcgggatgtacctgtgctcgttcggcctcggctgcatttacattttcctgcagttcgccgtcagccacacgcacctgccggtgaccaacccggaggaccagctgcactggctcgagtacgcggccgaccacacggtgaacattagcaccaagtcctggctcgtcacgtggtggatgtcgaacctgaactttcagatcgagcaccacctcttccccacggcgccgcagttccgcttcaaggaaatcagtcctcgcgtcgaggccctcttcaagcgccacaacctcccgtactacgacctgccctacacgagcgcggtctcgaccacctttgccaatctttattccgtcggccactcggtcggcgccgacaccaagaagcaggactga

SEQ ID NO: 52 - protein, 439 aa, Thraustochytrium ssp.
MGKGSEGRSAAREMTAEANGDKRKTILIEGVLYDATNFKHPGGSIINFLTEGEAGVDATQAYREFHQRSGKADKYLKSLPKLDASKVESRFSAKEQARRDAMTRDYAAFREELVAEGYFDPSIPHMIYRVVEIVALFALSFWLMSKASPTSLVLGVVMNGIAQGRCGWVMHEMGHGSFTGVIWLDDRMCEFFYGVGCGMSGHYWKNQHSKHHAAPNRLEHDVDLNTLPLVAFNERVVRKVKPGSLLALWLRVQAYLFAPVSCLLIGLGWTLYLHPRYMLRTKRHMEFVWIFARYIGWFSLMGALGYSPGTSVGMYLCSFGLGCIYIFLQFAVSHTHLPVTNPEDQLHWLEYAADHTVNISTKSWLVTWWMSNLNFQIEHHLFPTAPQFRFKEISPRVEALFKRHNLPYYDLPYTSAVSTTFANLYSVGHSVGADTKKQD

SEQ ID NO: 53 - DNA, 1371 bp, Ostreococcus tauri
  CDS (1)..(1371)
atgtgcgtggagacggaaaataacgatgggatccccacggtggagatcgcgttcgacggtgagcgcgagcgggcggaggcaaacgtgaagctgtccgcggagaagatggagccggcggcgctggcgaagacgttcgcgaggcggtacgtcgtgatcgagggggtggagtacgatgtgacggattttaagcacccgggaggaacggttattttctatgcgttgtcaaacaccggggcggacgcgacggaagcgttcaaggagtttcatcatcggtcgagaaaggcgaggaaagccttggcggcgctcccgtctcgaccggccaagacggccaaggtggacgacgcggagatgctccaagatttcgccaagtggcggaaagaattggagagagatggattcttcaagccctctccggcgcacgtggcgtatcgcttcgccgagctcgcggcgatgtacgctctcgggacgtacctgatgtacgctcgatacgtcgtctcctcggtgctcgtgtacgcttgctttttcggcgcccgatgcggttgggtgcagcacgagggcggacacagctcgctgacgggcaacatttggtgggacaagcgcatccaggccttcacagccgggttcggtctcgccggtagcggcgacatgtggaactcgatgcacaacaagcatcacgcgacgcctcaaaaggttcgtcacgacatggatctggacaccacccccgcggtggcgttcttcaacaccgcggtggaagacaatcgtccccgtggctttagcaagtactggttgcgccttcaggcgtggaccttcatccccgtgacgtccggcttggtgctccttttctggatgtttttcctccacccctccaaggctttgaagggtggcaagtacgaagagttggtgtggatgctcgccgcgcacgtcatccgcacgtggacgatcaaggcggtgaccggattcaccgcgatgcagtcctacggcttatttttggcgacgagctgggtgagcggctgctatctgtttgcacacttctccacgtcgcacacgcacctggatgtggtgcccgcggacgagcatctctcctgggttcgatacgccgtcgatcacacgatcgacatcgatccgagtcaaggttgggtgaactggttgatgggctacctcaactgccaagtcatccaccacctctttccgagcatgccgcagttccgccagcccgaggtatctcgccgcttcgtcgcctttgcgaaaaagtggaacctcaactacaaggtcatgacctacgccggtgcgtggaaggcaacgctcggaaacctcgacaacgtgggtaagcactactacgtgcacggccaacactccggaaagacggcgtaa

SEQ ID NO: 54 - protein, 456 aa, Ostreococcus tauri
MCVETENNDGIPTVEIAFDGERERAEANVKLSAEKMEPAALAKTFARRYVVIEGVEYDVTDFKHPGGTVIFYALSNTGADATEAFKEFHHRSRKARKALAALPSRPAKTAKVDDAEMLQDFAKWRKELERDGFFKPSPAHVAYRFAELAAMYALGTYLMYARYVVSSVLVYACFFGARCGWVQHEGGHSSLTGNIWWDKRIQAFTAGFGLAGSGDMWNSMHNKHHATPQKVRHDMDLDTTPAVAFFNTAVEDNRPRGFSKYWLRLQAWTFIPVTSGLVLLFWMFFLHPSKALKGGKYEELVWMLAAHVIRTWTIKAVTGFTAMQSYGLFLATSWVSGCYLFAHFSTSHTHLDVVPADEHLSWVRYAVDHTIDIDPSQGWVNWLMGYLNCQVIHHLFPSMPQFRQPEVSRRFVAFAKKWNLNYKVMTYAGAWKATLGNLDNVGKHYYVHGQHSGKTA

SEQ ID NO: 55 - DNA, 1254 bp, Leishmania major
  CDS (1)..(1254)
atggccctcgacaatgtccgtccgcaccaaccgaacgaggtgctgatcgatggcgtcctttacgactgcaccgatttccggcatccgggtggcagcattctgaaatactacctcggcagcggcgacgccaccgagacgtaccaacagttccacttgaagctgcccagggcggacaagtatctcaagcggctgccgaatcgcccggcgccgccacagcacagcgtcaacgtggatgagcagaagcgattggagaagctctcgcgggacttcaaggcgctgcaggatgcgtgcgtagaggagggcctttttaacgccagctggccgcacatcgtctaccggttttctgagctgatcctgatgcacgccatcggtctttacatgctcttccgtcttccgatcctgtggcccgtcgcgctggtgatccttggagtggcggaggggcgatgtggctggtggatgcacgaggccggtcactacagcgtcacaggcattccgtggttggacattaaaatacaggaggtactctacggacttggcgatggaatgagcgcgtcgtggtggcggtcgcagcataacaagcatcacgctactccgcagaagcaccggcacgacgtggaccttgagacgctgcctctcgtcgccttcaacaagatcatcgcgcgccgcggcaagaggaacgcgagcattcgccgctggatctccctgcagatgttcctcttcggccccgtcacctgctcccttgtcgccctctactggcagctcttcctacacgtccgccacgccatgcgcactcagcgttacacagagggctctgccatcctgtgccgctggatcgtggtcggcgttatctgtcaccagctgcaggtctcgttctggcaaggcctcggcggcgttctcttctcccaggccttcagcgccgcctacatcttcataaacttcgccctcaaccactctcacctgccgatgcttccggaagacgaacacgcgcacttcgtcgagtacgcggccatctacaccatgaacgtgacaccgtcgtggttcgtgacgtggttcatgggctaccttaactaccaggtggaacaccacctcttccctaccatgccacagttccgcttcgtccaactggcgccgcgagtgcggaaactttttgaggaaaacggcctcaagtacgattcgcgtccgtacatggagtcgctccagaaaaccttcaagaacctcggcgacgtggccgagttcatcgttgctgggaactaa

SEQ ID NO: 56 - protein, 417 aa, Leishmania major
MALDNVRPHQPNEVLIDGVLYDCTDFRHPGGSILKYYLGSGDATETYQQFHLKLPRADKYLKRLPNRPAPPQHSVNVDEQKRLEKLSRDFKALQDACVEEGLFNASWPHIVYRFSELILMHAIGLYMLFRLPILWPVALVILGVAEGRCGWWMHEAGHYSVTGIPWLDIKIQEVLYGLGDGMSASWWRSQHNKHHATPQKHRHDVDLETLPLVAFNKIIARRGKRNASIRRWISLQMFLFGPVTCSLVALYWQLFLHVRHAMRTQRYTEGSAILCRWIVVGVICHQLQVSFWQGLGGVLFSQAFSAAYIFINFALNHSHLPMLPEDEHAHFVEYAAIYTMNVTPSWFVTWFMGYLNYQVEHHLFPTMPQFRFVQLAPRVRKLFEENGLKYDSRPYMESLQKTFKNLGDVAEFIVAGN

SEQ ID NO: 57 - protein, 401 aa, Artificial sequence
  Amino acid sequence obtainable by alignment of SEQ ID No. 52, 54, and/or 56
  Variant (2)..(2): Xaa in position 2 is any amino acid
  Variant (5)..(5): Xaa in position 5 is any amino acid
  Variant (8)..(8): Xaa in position 8 is any amino acid
  Variant (10)..(10): Xaa in position 10 is any amino acid
  Variant (12)..(12): Xaa in position 12 is any amino acid
  Variant (17)..(26): Xaa in position 17 to 26 is any amino acid
  Variant (27)..(29): Xaa in position 27 to 29 is any or no amino acid
  Variant (33)..(37): Xaa in position 33 to 37 is any amino acid
  Variant (40)..(44): Xaa in position 40 to 44 is any amino acid
  Variant (46)..(46): Xaa in position 46 is any amino acid
  Variant (48)..(48): Xaa in position 48 is any amino acid
  Variant (50)..(51): Xaa in position 50 to 51 is any amino acid
  Variant (54)..(56): Xaa in position 54 to 56 is any amino acid
  Variant (58)..(69): Xaa in position 58 to 69 is any amino acid
  Variant (70)..(77): Xaa in position 70 to 77 is any or no amino acid
  Variant (79)..(89): Xaa in position 79 to 89 is any amino acid
  Variant (91)..(91): Xaa in position 91 is any amino acid
  Variant (93)..(94): Xaa in position 93 to 94 is any amino acid
  Variant (96)..(97): Xaa in position 96 to 97 is any amino acid
  Variant (99)..(100): Xaa in position 99 to 100 is any amino acid
  Variant (103)..(104): Xaa in position 103 to 104 is any amino acid
  Variant (106)..(110): Xaa in position 106 to 110 is any amino acid
  Variant (112)..(127): Xaa in position 112 to 127 is any amino acid
  Variant (128)..(129): Xaa in position 128 to 129 is any or no amino acid
  Variant (131)..(137): Xaa in position 131 to 137 is any amino acid
  Variant (142)..(143): Xaa in position 142 to 143 is any amino acid
  Variant (146)..(146): Xaa in position 146 is any amino acid
  Variant (149)..(149): Xaa in position 149 is any amino acid
  Variant (151)..(151): Xaa in position 151 is any amino acid
  Variant (154)..(155): Xaa in position 154 to 155 is any amino acid
  Variant (157)..(157): Xaa in position 157 is any amino acid
  Variant (159)..(166): Xaa in position 159 to 166 is any amino acid
  Variant (168)..(168): Xaa in position 168 is any amino acid
  Variant (170)..(172): Xaa in position 170 to 172 is any amino acid
  Variant (174)..(176): Xaa in position 174 to 176 is any amino acid
  Variant (178)..(180): Xaa in position 178 to 180 is any amino acid
  Variant (182)..(182): Xaa in position 182 is any amino acid
  Variant (187)..(187): Xaa in position 187 is any amino acid
  Variant (189)..(192): Xaa in position 189 to 192 is any amino acid
  Variant (195)..(195): Xaa in position 195 is any amino acid
  Variant (198)..(198): Xaa in position 198 is any amino acid
  Variant (200)..(200): Xaa in position 200 is any amino acid
  Variant (202)..(202): Xaa in position 202 is any amino acid
  Variant (206)..(221): Xaa in position 206 to 221 is any amino acid
  Variant (223)..(225): Xaa in position 223 to 225 is any amino acid
  Variant (227)..(229): Xaa in position 227 to 229 is any amino acid
  Variant (231)..(231): Xaa in position 231 is any amino acid
  Variant (234)..(236): Xaa in position 234 to 236 is any amino acid
  Variant (238)..(239): Xaa in position 238 to 239 is any amino acid
  Variant (241)..(241): Xaa in position 241 is any amino acid
  Variant (243)..(245): Xaa in position 243 to 245 is any amino acid
  Variant (248)..(258): Xaa in position 248 to 258 is any amino acid
  Variant (260)..(285): Xaa in position 260 to 285 is any amino acid
  Variant (286)..(286): Xaa in position 286 is any or no amino acid
  Variant (288)..(289): Xaa in position 288 to 289 is any amino acid
  Variant (291)..(298): Xaa in position 291 to 298 is any amino acid
  Variant (300)..(300): Xaa in position 300 is any amino acid
  Variant (302)..(303): Xaa in position 302 to 303 is any amino acid
  Variant (305)..(307): Xaa in position 305 to 307 is any amino acid
  Variant (309)..(309): Xaa in position 309 is any amino acid
  Variant (312)..(324): Xaa in position 312 to 324 is any amino acid
  Variant (327)..(329): Xaa in position 327 to 329 is any amino acid
  Variant (331)..(338): Xaa in position 331 to 338 is any amino acid
  Variant (339)..(339): Xaa in position 339 is any or no amino acid
  Variant (341)..(341): Xaa in position 341 is any amino acid
  Variant (343)..(343): Xaa in position 343 is any amino acid
  Variant (345)..(346): Xaa in position 345 to 346 is any amino acid
  Variant (349)..(349): Xaa in position 349 is any amino acid
  Variant (351)..(352): Xaa in position 351 to 352 is any amino acid
  Variant (358)..(359): Xaa in position 358 to 359 is any amino acid
  Variant (364)..(369): Xaa in position 364 to 369 is any amino acid
  Variant (371)..(379): Xaa in position 371 to 379 is any amino acid
  Variant (381)..(381): Xaa in position 381 is any amino acid
  Variant (383)..(386): Xaa in position 383 to 386 is any amino acid
  Variant (388)..(393): Xaa in position 388 to 393 is any amino acid
  Variant (395)..(396): Xaa in position 395 to 396 is any amino acid
  Variant (399)..(400): Xaa in position 399 to 400 is any amino acid
IXGVXYDXTXFXHPGGXXXXXXXXXXXXXDATXXXXXFHXXXXXAXKXLXXLPXXXAXXXXXXXXXXXXXXXXXXXXDXXXXXXXXXXXGXFXXSXXHXXYRXXEXXXXXAXXXXXXXXXXXXXXXXXXVXXXXXXXRCGWXXHEXGHXSXTGXXWXDXXXXXXXXGXGXXXSXXXWXXXHXKHHAXPXXXXHDXDLXTXPXVAFXXXXXXXXXXXXXXXXWXXXQXXXFXPVXXXLXXLXWXXXLHXXXXXXXXXXXEXXXXXXXXXXXXXXXXXXXXXXXXXXXGXXLXXXXXXXXYXFXXFXXXHXHLXXXXXXXXXXXXXYAXXXTXXXXXXXXXVXWXMXXLNXQXXHHLFPXXPQFRXXXXXXRXXXXXXXXXLXYXXXXYXXXXXXTXXNLXXV

SEQ ID NO: 58 - protein, 59 aa, Artificial sequence
  Amino acid sequence obtainable by alignment of SEQ ID No. 52, 54, and/or 56
  Variant (3)..(4): Xaa in position 3 to 4 is any amino acid
  Variant (7)..(7): Xaa in position 7 is any amino acid
  Variant (10)..(10): Xaa in position 10 is any amino acid
  Variant (12)..(12): Xaa in position 12 is Phe, Leu or Val
  Variant (15)..(15): Xaa in position 15 is any or no amino acid
  Variant (17)..(17): Xaa in position 17 is any or no amino acid
  Variant (19)..(19): Xaa in position 19 is any amino acid
  Variant (21)..(21): Xaa in position 21 is any amino acid
  Variant (22)..(22): Xaa in position 22 is Lys or Arg
  Variant (23)..(23): Xaa in position 23 is Ile or Met
  Variant (24)..(24): Xaa in position 24 is any amino acid
  Variant (25)..(25): Xaa in position 25 is Ala or Glu
  Variant (26)..(26): Xaa in position 26 is Phe or Val
  Variant (27)..(28): Xaa in position 27 to 28 is any amino acid
  Variant (30)..(30): Xaa in position 30 is Phe, Leu or Val
  Variant (32)..(32): Xaa in position 32 is any amino acid
  Variant (33)..(33): Xaa in position 33 is Ala or Gly
  Variant (34)..(34): Xaa in position 34 is any amino acid
  Variant (36)..(36): Xaa in position 36 is Ala or Gly
  Variant (37)..(38): Xaa in position 37 to 38 is any amino acid
  Variant (40)..(40): Xaa in position 40 is any amino acid
  Variant (41)..(41): Xaa in position 41 is Asn or Ser
  Variant (42)..(42): Xaa in position 42 is any amino acid
  Variant (44)..(44): Xaa in position 44 is Asn or Ser
  Variant (49)..(49): Xaa in position 49 is Ala or Thr
  Variant (51)..(51): Xaa in position 51 is Asn or Gln
  Variant (52)..(52): Xaa in position 52 is Lys or Arg
  Variant (53)..(53): Xaa in position 53 is any amino acid
  Variant (54)..(54): Xaa in position 54 is Glu or Arg
  Variant (57)..(57): Xaa in position 57 is Met or Val
GWXXHEXGHXSXTGXIXWXDXXXXXXXXGXGXXXSXXXWXXXHXKHHAXPXXXXHDXDL

SEQ ID NO: 59 - protein, 50 aa, Artificial sequence
  Amino acid sequence obtainable by alignment of SEQ ID No. 52, 54, and/or 56
  Variant (2)..(2): Xaa in position 2 is Asn or Thr
  Variant (4)..(4): Xaa in position 4 is any amino acid
  Variant (6)..(6): Xaa in position 6 is any amino acid
  Variant (7)..(8): Xaa in position 7 to 8 is any or no amino acid
  Variant (10)..(10): Xaa in position 10 is any amino acid
  Variant (11)..(12): Xaa in position 11 to 12 is any or no amino acid
  Variant (14)..(14): Xaa in position 14 is Ile or Val
  Variant (15)..(15): Xaa in position 15 is any amino acid
  Variant (21)..(21): Xaa in position 21 is Ser or Thr
  Variant (22)..(22): Xaa in position 22 is any amino acid
  Variant (27)..(28): Xaa in position 27 to 28 is any amino acid
  Variant (29)..(29): Xaa in position 29 is Glu or Gln
  Variant (30)..(30): Xaa in position 30 is Ile, Leu or Val
  Variant (31)..(31): Xaa in position 31 is Ala or Ser
  Variant (32)..(32): Xaa in position 32 is any amino acid
  Variant (34)..(34): Xaa in position 34 is Phe or Val
  Variant (35)..(36): Xaa in position 35 to 36 is any amino acid
  Variant (37)..(37): Xaa in position 37 is Phe or Leu
  Variant (38)..(38): Xaa in position 38 is any amino acid
  Variant (39)..(39): Xaa in position 39 is Glu or Lys
  Variant (40)..(40): Xaa in position 40 is Glu, Lys or Arg
  Variant (41)..(41): Xaa in position 41 is any amino acid
  Variant (42)..(42): Xaa in position 42 is Gly or Asn
  Variant (44)..(44): Xaa in position 44 is any amino acid
  Variant (46)..(46): Xaa in position 46 is any amino acid
  Variant (47)..(47): Xaa in position 47 is Asp, Ser or Val
  Variant (48)..(48): Xaa in position 48 is any amino acid
  Variant (49)..(49): Xaa in position 49 is Pro or Thr
VXWXMXXXNXXXQXXHHLFPXXPQFRXXXXXXRXXXXXXXXXLXYXXXXY

SEQ ID NO: 60 - protein, 20 aa, Artificial sequence
  Amino acid sequence obtainable by alignment of SEQ ID No. 52, 54, and/or 56
  Variant (2)..(2): Xaa in position 2 is Asp or Glu
  Variant (5)..(5): Xaa in position 5 is any amino acid
  Variant (8)..(8): Xaa in position 8 is Ala, Cys or Val
  Variant (10)..(10): Xaa in position 10 is Asp or Asn
  Variant (12)..(12): Xaa in position 12 is Lys or Arg
  Variant (17)..(17): Xaa in position 17 is any amino acid
  Variant (18)..(18): Xaa in position 18 is any or no amino acid
  Variant (20)..(20): Xaa in position 20 is Phe, Ile or Leu
IXGVXYDXTXFXHPGGXXIX

SEQ ID NO: 61 - protein, 61 aa, Artificial sequence
  Amino acid sequence obtainable by alignment of SEQ ID No. 52, 54, and/or 56
  Variant (2)..(2): Xaa in position 2 is any amino acid
  Variant (4)..(4): Xaa in position 4 is Ala or Leu
  Variant (8)..(10): Xaa in position 8 to 10 is any amino acid
  Variant (11)..(11): Xaa in position 11 is Ala, Ile or Val
  Variant (12)..(12): Xaa in position 12 is Ala or Val
  Variant (13)..(13): Xaa in position 13 is Glu or Arg
  Variant (14)..(14): Xaa in position 14 is Asp, Lys or Arg
  Variant (15)..(15): Xaa in position 15 is Gly, Asn or Val
  Variant (16)..(16): Xaa in position 16 is Lys or Arg
  Variant (17)..(18): Xaa in position 17 to 18 is any amino acid
  Variant (19)..(19): Xaa in position 19 is Ala, Gly or Ser
  Variant (20)..(23): Xaa in position 20 to 23 is any amino acid
  Variant (25)..(26): Xaa in position 25 to 26 is any or no amino acid
  Variant (28)..(29): Xaa in position 28 to 29 is any or no amino acid
  Variant (31)..(31): Xaa in position 31 is any amino acid
  Variant (32)..(32): Xaa in position 32 is Phe, Trp or Tyr
  Variant (33)..(33): Xaa in position 33 is any amino acid
  Variant (35)..(35): Xaa in position 35 is Ala, Gly or Ile
  Variant (38)..(38): Xaa in position 38 is Ser or Thr
  Variant (39)..(39): Xaa in position 39 is Cys or Ser
  Variant (40)..(40): Xaa in position 40 is any amino acid
  Variant (42)..(42): Xaa in position 42 is Ile or Val
  Variant (43)..(43): Xaa in position 43 is Ala, Gly or Leu
  Variant (45)..(45): Xaa in position 45 is any amino acid
  Variant (47)..(47): Xaa in position 47 is any amino acid
  Variant (48)..(48): Xaa in position 48 is Phe or Leu
  Variant (49)..(49): Xaa in position 49 is Phe or Tyr
  Variant (52)..(52): Xaa in position 52 is Pro or Val
  Variant (53)..(53): Xaa in position 53 is Arg or Ser
  Variant (54)..(55): Xaa in position 54 to 55 is any amino acid
  Variant (56)..(56): Xaa in position 56 is Leu or Met
  Variant (57)..(57): Xaa in position 57 is Lys or Arg
  Variant (58)..(58): Xaa in position 58 is Gly or Thr
  Variant (59)..(59): Xaa in position 59 is any amino acid
  Variant (60)..(60): Xaa in position 60 is Lys or Arg
  Variant (61)..(61): Xaa in position 61 is His or Tyr
TXPXVAFXXXXXXXXXXXXXXXXWXXLXXQXXXFXPVXXXLXXLXWXXXLHXXXXXXXXXX

SEQ ID NO: 62 - protein, 34 aa, Artificial sequence
  Amino acid sequence obtainable by alignment of SEQ ID No. 52, 54, and/or 56
  Variant (2)..(5): Xaa in position 2 to 5 is any amino acid
  Variant (6)..(6): Xaa in position 6 is any or no amino acid
  Variant (8)..(9): Xaa in position 8 to 9 is any or no amino acid
  Variant (11)..(11): Xaa in position 11 is Asp or Pro
  Variant (12)..(12): Xaa in position 12 is Met or Val
  Variant (13)..(13): Xaa in position 13 is any amino acid
  Variant (14)..(14): Xaa in position 14 is Asn or Pro
  Variant (15)..(15): Xaa in position 15 is any amino acid
  Variant (16)..(17): Xaa in position 16 to 17 is Asp or Glu
  Variant (18)..(18): Xaa in position 18 is any amino acid
  Variant (19)..(19): Xaa in position 19 is Ala or Leu
  Variant (20)..(20): Xaa in position 20 is any amino acid
  Variant (21)..(21): Xaa in position 21 is Phe or Trp
  Variant (22)..(22): Xaa in position 22 is Leu or Val
  Variant (23)..(23): Xaa in position 23 is Glu or Arg
  Variant (26)..(26): Xaa in position 26 is Ala or Val
  Variant (27)..(27): Xaa in position 27 is any amino acid
  Variant (28)..(28): Xaa in position 28 is His or Tyr
  Variant (30)..(30): Xaa in position 30 is Ile, Met or Val
  Variant (31)..(31): Xaa in position 31 is Asp or Asn
  Variant (32)..(32): Xaa in position 32 is Ile or Val
  Variant (33)..(33): Xaa in position 33 is Asp, Ser or Thr
  Variant (34)..(34): Xaa in position 34 is Pro or Thr
AXXXXXHXXLXXXXXXXXXXXXXYAXXXTXXXXX

SEQ ID NO: 63 - protein, 28 aa, Artificial sequence
  Amino acid sequence obtainable by alignment of SEQ ID No. 52, 54, and/or 56
  Variant (4)..(4): Xaa in position 4 is Glu or Gln
  Variant (5)..(5): Xaa in position 5 is Ala or Thr
  Variant (6)..(6): Xaa in position 6 is Phe or Tyr
  Variant (7)..(7): Xaa in position 7 is any amino acid
  Variant (8)..(8): Xaa in position 8 is Glu or Gln
  Variant (11)..(11): Xaa in position 11 is any amino acid
  Variant (12)..(12): Xaa in position 12 is Lys or Arg
  Variant (13)..(14): Xaa in position 13 to 14 is any amino acid
  Variant (15)..(15): Xaa in position 15 is Lys or Arg
  Variant (17)..(17): Xaa in position 17 is Asp or Arg
  Variant (19)..(19): Xaa in position 19 is any amino acid
  Variant (21)..(22): Xaa in position 21 to 22 is any amino acid
  Variant (25)..(26): Xaa in position 25 to 26 is any amino acid
  Variant (27)..(27): Xaa in position 27 is Asp or Pro
DATXXXXXFHXXXXXAXKXLXXLPXXXA

SEQ ID NO: 64 - DNA, 903 bp, Ostreococcus tauri
  CDS (1)..(903)
atgtctgcttctggagctttgttgcctgctattgctttcgctgcttacgcttacgctacctacgcttatgctttcgagtggtctcatgctaacggaatcgataacgtggatgctagagagtggattggagctttgtctttgagactccctgcaattgctaccaccatgtacctcttgttctgccttgtgggacctagattgatggctaagagggaggcttttgatcctaagggattcatgctcgcttacaacgcttaccaaaccgctttcaacgttgtggtgctcggaatgttcgctagagagatctctggattgggacaacctgtttggggatctactatgccttggagcgataggaagtccttcaagattttgttgggagtgtggctccattacaacaataagtacctcgagttgttggatactgtgttcatggtggctaggaaaaagaccaagcagctctctttcttgcatgtgtaccatcatgctttgttgatttgggcttggtggcttgtttgtcatctcatggctaccaacgattgcatcgatgcttatttcggagctgcttgcaactctttcatccacatcgtgatgtactcctactacctcatgtctgctttgggaattagatgcccttggaagagatatatcacccaggctcagatgttgcaattcgtgatcgtgttcgctcatgctgttttcgtgctcagacaaaagcactgccctgttactttgccttgggcacaaatgttcgtgatgacaaatatgttggtgctcttcggaaacttctacctcaaggcttactctaacaagtctaggggagatggagcttcttctgttaagcctgctgagactactagagcaccttctgtgagaagaaccaggtccaggaagatcgattga

SEQ ID NO: 65 - protein, 300 aa, Ostreococcus tauri
MSASGALLPAIAFAAYAYATYAYAFEWSHANGIDNVDAREWIGALSLRLPAIATTMYLLFCLVGPRLMAKREAFDPKGFMLAYNAYQTAFNVVVLGMFAREISGLGQPVWGSTMPWSDRKSFKILLGVWLHYNNKYLELLDTVFMVARKKTKQLSFLHVYHHALLIWAWWLVCHLMATNDCIDAYFGAACNSFIHIVMYSYYLMSALGIRCPWKRYITQAQMLQFVIVFAHAVFVLRQKHCPVTLPWAQMFVMTNMLVLFGNFYLKAYSNKSRGDGASSVKPAETTRAPSVRRTRSRKID

SEQ ID NO: 66 - DNA, 834 bp, Pavlova sp
  CDS (1)..(834)
atgatgttggccgcaggctatcttctagtgctctcggccgctcgccagagcttccagcaggacattgacaaccccaacggggcctactcgacctcgtggactggcctgcccattgtgatgtctgtggtctatctcagcggtgtgtttgggctcacaaagtacttcgagaaccggaagcccatgacggggctgaaggactacatgttcacttacaatctctaccaggtgatcatcaacgtgtggtgcgtggtggcctttctcctggaggtgcggcgtgcgggcatgtcactcatcggcaataaggtggaccttgggcccaactccttcaggctcggcttcgtcacgtgggtgcactacaacaacaagtacgtggagctcctcgacaccctatggatggtgctgcgcaagaagacgcagcaggtctccttcctccacgtctatcatcacgtgcttctgatgtgggcctggttcgttgtcgtcaagctcggcaatggtggtgacgcatattttggcggtctcatgaactcgatcatccacgtgatgatgtattcctactacaccatggcgctcctgggctggtcatgcccctggaagcgctacctcacgcaggcacagctcgtgcagttttgcatctgcctcgcccactccacatgggcggcagtaacgggtgcctacccgtggcgaatttgcttggtggaggtgtgggtgatggtgtccatgctggtgctcttcacacgcttctaccgccaggcctatgccaaggaggcgaaggccaaggaggcgaaaaagctcgcacaggaggcatcacaggccaaggcggtcaaggcggagtaa

SEQ ID NO: 67 - protein, 277 aa, Pavlova sp
MMLAAGYLLVLSAARQSFQQDIDNPNGAYSTSWTGLPIVMSVVYLSGVFGLTKYFENRKPMTGLKDYMFTYNLYQVIINVWCVVAFLLEVRRAGMSLIGNKVDLGPNSFRLGFVTWVHYNNKYVELLDTLWMVLRKKTQQVSFLHVYHHVLLMWAWFVVVKLGNGGDAYFGGLMNSIIHVMMYSYYTMALLGWSCPWKRYLTQAQLVQFCICLAHSTWAAVTGAYPWRICLVEVWVMVSMLVLFTRFYRQAYAKEAKAKEAKKLAQEASQAKAVKAE

SEQ ID NO: 68 - DNA, 1077 bp, Thalassiosira pseudonana
  CDS (1)..(1077)
atgtgctcatcaccgccgtcacaatccaaaacaacatccctcctagcacggtacaccaccgccgccctcctcctcctcaccctcacaacatggtgccacttcgccttcccagccgccaccgccacacccggcctcaccgccgaaatgcactcctacaaagtcccactcggtctcaccgtattctacctgctgagtctaccgtcactaaagtacgttacggacaactaccttgccaaaaagtatgatatgaagtcactcctaacggaatcaatggtgttgtacaatgtggcgcaagtgctgctcaatgggtggacggtgtatgcgattgtggatgcggtgatgaatagagaccatccgtttattggaagtagaagtttggttggggcggcgttgcatagtgggagctcgtatgcggtgtgggttcattattgtgataagtatttggagttctttgatacgtattttatggtgttgagggggaaaatggaccaggtctccttcctccacatctaccaccacacgaccatagcgtgggcatggtggatcgccctccgcttctcccccggtggagacatttacttcggggcactcctcaactccatcatccacgtcctcatgtattcctactacgcccttgccctactcaaggtcagttgtccatggaaacgatacctgactcaagctcaattattgcaattcacaagtgtggtggtttatacggggtgtacgggttatactcattactatcatacgaagcatggagcggatgagacacagcctagtttaggaacgtattatttctgttgtggagtgcaggtgtttgagatggttagtttgtttgtactcttttccatcttttataaacgatcctattcgaagaagaacaagtcaggaggaaaggatagcaagaagaatgatgatgggaataatgaggatcaatgtcacaaggctatgaaggatatatcggagggtgcgaaggaggttgtggggcatgcagcgaaggatgctggaaagttggtggctacggcgagtaaggctgtaaagaggaagggaactcgtgttactggtgccatgtag

SEQ ID NO: 69 - protein, 358 aa, Thalassiosira pseudonana
MCSSPPSQSKTTSLLARYTTAALLLLTLTTWCHFAFPAATATPGLTAEMHSYKVPLGLTVFYLLSLPSLKYVTDNYLAKKYDMKSLLTESMVLYNVAQVLLNGWTVYAIVDAVMNRDHPFIGSRSLVGAALHSGSSYAVWVHYCDKYLEFFDTYFMVLRGKMDQVSFLHIYHHTTIAWAWWIALRFSPGGDIYFGALLNSIIHVLMYSYYALALLKVSCPWKRYLTQAQLLQFTSVVVYTGCTGYTHYYHTKHGADETQPSLGTYYFCCGVQVFEMVSLFVLFSIFYKRSYSKKNKSGGKDSKKNDDGNNEDQCHKAMKDISEGAKEVVGHAAKDAGKLVATASKAVKRKGTRVTGAM

SEQ ID NO: 70 - DNA, 903 bp, Ostreococcus tauri
  CDS (1)..(903)
atgagcgcctccggtgcgctgctgcccgcgatcgcgtccgccgcgtacgcgtacgcgacgtacgcctacgcctttgagtggtcgcacgcgaatggcatcgacaacgtcgacgcgcgcgagtggatcggtgcgctgtcgttgaggctcccggcgatcgcgacgacgatgtacctgttgttctgcctggtcggaccgaggttgatggcgaagcgcgaggcgttcgacccgaaggggttcatgctggcgtacaatgcgtatcagacggcgttcaacgtcgtcgtgctcgggatgttcgcgcgagagatctcggggctggggcagcccgtgtgggggtcaaccatgccgtggagcgatagaaaatcgtttaagatcctcctcggggtgtggttgcactacaacaacaaatatttggagctattggacactgtgttcatggttgcgcgcaagaagacgaagcagttgagcttcttgcacgtttatcatcacgccctgttgatctgggcgtggtggttggtgtgtcacttgatggccacgaacgattgtatcgatgcctacttcggcgcggcgtgcaactcgttcattcacatcgtgatgtactcgtattatctcatgtcggcgctcggcattcgatgcccgtggaagcgatacatcacccaggctcaaatgctccaattcgtcattgtcttcgcgcacgccgtgttcgtgctgcgtcagaagcactgcccggtcacccttccttgggcgcaaatgttcgtcatgacgaacatgctcgtgctcttcgggaacttctacctcaaggcgtactcgaacaagtcgcgcggcgacggcgcgagttccgtgaaaccagccgagaccacgcgcgcgcccagcgtgcgacgcacgcgatctcgaaaaattgactaa

SEQ ID NO: 71 - protein, 300 aa, Ostreococcus tauri
MSASGALLPAIASAAYAYATYAYAFEWSHANGIDNVDAREWIGALSLRLPAIATTMYLLFCLVGPRLMAKREAFDPKGFMLAYNAYQTAFNVVVLGMFAREISGLGQPVWGSTMPWSDRKSFKILLGVWLHYNNKYLELLDTVFMVARKKTKQLSFLHVYHHALLIWAWWLVCHLMATNDCIDAYFGAACNSFIHIVMYSYYLMSALGIRCPWKRYITQAQMLQFVIVFAHAVFVLRQKHCPVTLPWAQMFVMTNMLVLFGNFYLKAYSNKSRGDGASSVKPAETTRAPSVRRTRSRKID

SEQ ID NO: 72 - protein, 339 aa, Artificial sequence
  Amino acid sequence obtainable by alignment of SEQ ID No. 65, 67, 69 and/or 71
  Variant (3)..(29): Xaa in position 3 to 29 is any amino acid
  Variant (30)..(43): Xaa in position 30 to 43 is any or no amino acid
  Variant (45)..(50): Xaa in position 45 to 50 is any amino acid
  Variant (53)..(73): Xaa in position 53 to 73 is any amino acid
  Variant (74)..(79): Xaa in position 74 to 79 is any or no amino acid
  Variant (81)..(82): Xaa in position 81 to 82 is any amino acid
  Variant (85)..(86): Xaa in position 85 to 86 is any amino acid
  Variant (88)..(90): Xaa in position 88 to 90 is any amino acid
  Variant (92)..(110): Xaa in position 92 to 110 is any amino acid
  Variant (112)..(127): Xaa in position 112 to 127 is any amino acid
  Variant (128)..(128): Xaa in position 128 is any or no amino acid
  Variant (130)..(130): Xaa in position 130 is any amino acid
  Variant (133)..(134): Xaa in position 133 to 134 is any amino acid
  Variant (137)..(137): Xaa in position 137 is any amino acid
  Variant (139)..(140): Xaa in position 139 to 140 is any amino acid
  Variant (143)..(144): Xaa in position 143 to 144 is any amino acid
  Variant (147)..(147): Xaa in position 147 is any amino acid
  Variant (149)..(149): Xaa in position 149 is any amino acid
  Variant (151)..(152): Xaa in position 151 to 152 is any amino acid
  Variant (154)..(154): Xaa in position 154 is any amino acid
  Variant (159)..(159): Xaa in position 159 is any amino acid
  Variant (163)..(166): Xaa in position 163 to 166 is any amino acid
  Variant (170)..(179): Xaa in position 170 to 179 is any amino acid
  Variant (180)..(182): Xaa in position 180 to 182 is any or no amino acid
  Variant (184)..(184): Xaa in position 184 is any amino acid
  Variant (188)..(190): Xaa in position 188 to 190 is any amino acid
  Variant (193)..(193): Xaa in position 193 is any amino acid
  Variant (196)..(197): Xaa in position 196 to 197 is any amino acid
  Variant (203)..(206): Xaa in position 203 to 206 is any amino acid
  Variant (208)..(210): Xaa in position 208 to 210 is any amino acid
  Variant (217)..(217): Xaa in position 217 is any amino acid
  Variant (222)..(223): Xaa in position 222 to 223 is any amino acid
  Variant (226)..(252): Xaa in position 226 to 252 is any amino acid
  Variant (253)..(267): Xaa in position 253 to 267 is any or no amino acid
  Variant (269)..(272): Xaa in position 269 to 272 is any amino acid
  Variant (276)..(277): Xaa in position 276 to 277 is any amino acid
  Variant (280)..(282): Xaa in position 280 to 282 is any amino acid
  Variant (284)..(291): Xaa in position 284 to 291 is any amino acid
  Variant (292)..(324): Xaa in position 292 to 324 is any or no amino acid
  Variant (326)..(337): Xaa in position 326 to 337 is any amino acid
  Variant (338)..(338): Xaa in position 338 is any or no amino acid
LLXXXXXXXXXXXXXXXXXXXXXXXXXXXXXXXXXXXXXXXXXPXXXXXXYLXXXXXXXXXXXXXXXXXXXXXXXXXXXMXXYNXXQXXXNXXXXXXXXXXXXXXXXXXXGXXXXXXXXXXXXXXXXXWXHYXXKYXEXXDTXXMVXRXKXXQXSFLHXYHHXXXXWAWXXXXXXXXXXXXXDXYFGXXXNSXIHXXMYSYYXXXXLXXXCPWKRYXTQAQXXQFXXXXXXXXXXXXXXXXXXXXXXXXXXXXXXXXXXXXXXXXXXMXXXXVLFXXFYXXXYXXXXXXXXXXXXXXXXXXXXXXXXXXXXXXXXXXXXXXXXXAXXXXXXXXXXXXXV

SEQ ID NO: 73 - protein, 45 aa, Artificial sequence
  Amino acid sequence obtainable by alignment of SEQ ID No. 65, 67, 69 and/or 71
  Variant (4)..(4): Xaa in position 4 is Ala or Gly
  Variant (5)..(5): Xaa in position 5 is Ala or Leu
  Variant (6)..(6): Xaa in position 6 is any amino acid
  Variant (9)..(9): Xaa in position 9 is Phe or Ile
  Variant (12)..(12): Xaa in position 12 is any or no amino acid
  Variant (14)..(14): Xaa in position 14 is any or no amino acid
  Variant (20)..(20): Xaa in position 20 is any amino acid
  Variant (21)..(21): Xaa in position 21 is Leu or Met
  Variant (22)..(22): Xaa in position 22 is Ala or Ser
  Variant (23)..(23): Xaa in position 23 is Ala or Leu
  Variant (25)..(26): Xaa in position 25 to 26 is any amino acid
  Variant (27)..(27): Xaa in position 27 is Arg or Ser
  Variant (34)..(34): Xaa in position 34 is Ile or Leu
  Variant (39)..(39): Xaa in position 39 is Leu or Met
  Variant (40)..(40): Xaa in position 40 is Leu or Val
  Variant (43)..(43): Xaa in position 43 is Cys, Thr or Val
  Variant (44)..(44): Xaa in position 44 is any amino acid
  Variant (45)..(45): Xaa in position 45 is Cys or Val
YFGXXXNSXIHXVXMYSYYXXXXLXXXCPWKRYXTQAQXXQFXXX

SEQ ID NO: 74 - protein, 43 aa, Artificial sequence
  Amino acid sequence obtainable by alignment of SEQ ID No. 65, 67, 69 and/or 71
  Variant (2)..(2): Xaa in position 2 is Leu or Val
  Variant (5)..(5): Xaa in position 5 is Cys or Asn
  Variant (6)..(6): Xaa in position 6 is Asp or Asn
  Variant (9)..(10): Xaa in position 9 to 10 is any or no amino acid
  Variant (12)..(12): Xaa in position 12 is any amino acid
  Variant (13)..(14): Xaa in position 13 to 14 is any or no amino acid
  Variant (17)..(17): Xaa in position 17 is any amino acid
  Variant (18)..(18): Xaa in position 18 is Phe or Trp
  Variant (21)..(21): Xaa in position 21 is Ala or Leu
  Variant (23)..(23): Xaa in position 23 is any amino acid
  Variant (25)..(26): Xaa in position 25 to 26 is any amino acid
  Variant (28)..(28): Xaa in position 28 is Leu or Val
  Variant (33)..(33): Xaa in position 33 is Ile or Val
  Variant (37)..(37): Xaa in position 37 is Ala, Thr or Val
  Variant (38)..(38): Xaa in position 38 is any amino acid
  Variant (39)..(39): Xaa in position 39 is Ile or Leu
  Variant (40)..(40): Xaa in position 40 is any amino acid
WXHYXXKYXXLXXXDTXXMVXRXKXXQXSFLHXYHHXXXXWAW

SEQ ID NO: 75 - protein, 37 aa, Artificial sequence
  Amino acid sequence obtainable by alignment of SEQ ID No. 65, 67, 69 and/or 71
  Variant (2)..(3): Xaa in position 2 to 3 is any or no amino acid
  Variant (5)..(5): Xaa in position 5 is any or no amino acid
  Variant (9)..(9): Xaa in position 9 is Gly, Ser or Thr
  Variant (10)..(10): Xaa in position 10 is any amino acid
  Variant (13)..(14): Xaa in position 13 to 14 is any amino acid
  Variant (15)..(15): Xaa in position 15 is Ala or Ser
  Variant (17)..(17): Xaa in position 17 is Ala or Ser
  Variant (18)..(18): Xaa in position 18 is any amino acid
  Variant (19)..(19): Xaa in position 19 is Glu or Lys
  Variant (20)..(20): Xaa in position 20 is Ala, Asn or Ser
  Variant (21)..(21): Xaa in position 21 is Lys or Arg
  Variant (22)..(22): Xaa in position 22 is Ala, Gly or Ser
  Variant (23)..(23): Xaa in position 23 is any amino acid
  Variant (24)..(24): Xaa in position 24 is Glu or Gly
  Variant (25)..(29): Xaa in position 25 to 29 is any amino acid
  Variant (30)..(30): Xaa in position 30 is Asn, Pro or Gln
  Variant (31)..(32): Xaa in position 31 to 32 is Ala, Asp or Glu
  Variant (33)..(33): Xaa in position 33 is Gly, Ser or Thr
  Variant (34)..(34): Xaa in position 34 is Asn, Gln or Thr
  Variant (35)..(36): Xaa in position 35 to 36 is any amino acid
  Variant (37)..(37): Xaa in position 37 is Ala, Asp or Pro
MXXLXVLFXXFYXXXYXXXXXXXXXXXXXXXXXXXXX

SEQ ID NO: 76 - protein, 19 aa, Artificial sequence
  Amino acid sequence obtainable by alignment of SEQ ID No. 65, 67, 69 and/or 71
  Variant (2)..(3): Xaa in position 2 to 3 is any amino acid
  Variant (4)..(7): Xaa in position 4 to 7 is any or no amino acid
  Variant (9)..(9): Xaa in position 9 is Phe, Leu or Val
  Variant (10)..(10): Xaa in position 10 is any amino acid
  Variant (13)..(13): Xaa in position 13 is Ala, Leu or Val
  Variant (14)..(14): Xaa in position 14 is any amino acid
  Variant (16)..(16): Xaa in position 16 is Thr or Val
  Variant (17)..(17): Xaa in position 17 is Ala, Ile or Leu
  Variant (18)..(18): Xaa in position 18 is Phe, Ile or Leu
KXXXXXXMXXYNXXQXXXN

SEQ ID NO: 77 - DNA, 1560 bp, Traustochytrium sp.
  CDS (1)..(1560)
atgacggtcggctacgacgaggagatcccgttcgagcaggtccgcgcgcacaacaagccggatgacgcctggtgcgcgatccacgggcacgtgtacgatgtgaccaagttcgcgagcgtgcacccgggcggcgacattatcctgctggccgcaggcaaggaggccaccgtgctgtacgagacttaccatgtgcggggcgtctcggacgcggtgctgcgcaagtaccgcatcggcaagctgccggacggccaaggcggcgcgaacgagaaggaaaagcggacgctctcgggcctctcgtcggcctcgtactacacgtggaacagcgacttttacagggtaatgcgcgagcgcgtcgtggctcggctcaaggagcgcggcaaggcccgccgcggaggctacgagctctggatcaaggcgttcctgctgctcgtcggcttctggagctcgctgtactggatgtgcacgctggacccctcgttcggggccatcctggccgccatgtcgctgggcgtctttgccgcctttgtgggcacgtgcatccagcacgacggcaaccacggcgcctttgcccagtcgcgatgggtcaacaaggttgccgggtggacgctcgacatgatcggcgccagcggcatgacgtgggagttccagcacgtcctgggccaccatccgtacacgaacctgatcgaggaggagaacggcctgcaaaaggtgagcggcaagaagatggacaccaagctggccgaccaggagagcgatccggacgtcttttccacgtacccgatgatgcgcctgcacccgtggcaccagaagcgctggtaccaccgtttccagcacatttacggccccttcatctttggcttcatgaccatcaacaaggtggtcacgcaggacgtcggtgtggtgctccgcaagcggctcttccagattgacgccgagtgccggtacgcgagcccaatgtacgtggcgcgtttctggatcatgaaggcgctcacggtgctctacatggtggccctgccgtgctacatgcagggcccgtggcacggcctcaagctgttcgcgatcgcgcactttacgtgcggcgaggtgctcgcaaccatgttcattgtgaaccacatcatcgagggcgtctcgtacgcttccaaggacgcggtcaagggcacgatggcgccgccgaagacgatgcacggcgtgacgcccatgaacaacacgcgcaaggaggtggaggcggaggcgtccaagtctggcgccgtggtcaagtcagtcccgctcgacgactgggccgccgtccagtgccagacctcggtgaactggagcgtcggctcgtggttctggaatcacttttccggcggcctcaaccaccagattgagcaccacctgttccccgggctcagccacgagacgtactaccacatccaggacgtcgttcagtccacctgcgccgagtacggcgtcccgtaccagcacgagccttcgctctggaccgcgtactggaagatgctcgagcacctccgtcagctcggcaatgaggagacccacgagtcctggcagcgcgctgcctga

SEQ ID NO: 78 - protein, 519 aa, Traustochytrium sp.
MTVGYDEEIPFEQVRAHNKPDDAWCAIHGHVYDVTKFASVHPGGDIILLAAGKEATVLYETYHVRGVSDAVLRKYRIGKLPDGQGGANEKEKRTLSGLSSASYYTWNSDFYRVMRERVVARLKERGKARRGGYELWIKAFLLLVGFWSSLYWMCTLDPSFGAILAAMSLGVFAAFVGTCIQHDGNHGAFAQSRWVNKVAGWTLDMIGASGMTWEFQHVLGHHPYTNLIEEENGLQKVSGKKMDTKLADQESDPDVFSTYPMMRLHPWHQKRWYHRFQHIYGPFIFGFMTINKVVTQDVGVVLRKRLFQIDAECRYASPMYVARFWIMKALTVLYMVALPCYMQGPWHGLKLFAIAHFTCGEVLATMFIVNHIIEGVSYASKDAVKGTMAPPKTMHGVTPMNNTRKEVEAEASKSGAVVKSVPLDDWAAVQCQTSVNWSVGSWFWNHFSGGLNHQIEHHLFPGLSHETYYHIQDVVQSTCAEYGVPYQHEPSLWTAYWKMLEHLRQLGNEETHESWQRAA

SEQ ID NO: 79 - DNA, 1560 bp, Thraustochytrium sp
  CDS (1)..(1560)
atgacggtcggctacgacggggagatcccgttcgagcaggtccgcgcgcacaacaagccggatgacgcctggtgcgcgatccacgggcacgtgtacgatgtgaccaagttcgcgagcgtgcacccgggcggcgacattatcctgctggccgcaggcaaggatgccaccgtgctgtacgagacttaccatgtgcggggcgtctcggacgcggtgctgcgcaagtaccgcatcggcaagctgccggacggccaaggcggcgcgaacgagaaggaaaagcggacgctctcgggcctctcgtcggcctcgtactacacgtggaacagcgacttttacagggtaatgcgcgagcgcgtcgtggctcggctcaaggagcgcggcaaggcccgccgcggaggctacgagctctggatcaaggcgctcctgctgctcgtcggcttctggagctcgctgtgctggatgtgcacgctggacccctcgttcggggccatcctggccgccatgtcgctgggcgtctttgccgcctttgtgggcacgtgcatccagcacgacggcaaccacggcgcctttgcccagtcgcgatgggtcaacaaggttgccgggtggacgctcgacatgatcggcgccagcggcatgacgtgggagttccagcacgccctgggccaccatccgtacacgaacctgatcgaggaggagaacggcctgcaaaaggtgagcggcaagaagatggacaccaagctggccgaccaggagagcgatccggacgtcttttccacgtacccgatgatgcgcctgcacccgtggcaccagaagcgctggtaccaccgtttccagcacatttacggccccttcatctttggcttcatgaccatcaacaaggtggtcacgcaggacgtcggtgtggtgttccgcaagcggctcttccagattgacgccgagtgccggtacgcgagcccaatgtacgtggcgcgtttctggatcatgaaggcgctcacggtgctctacatggtggccctgccgtgctacatgcagggcccgtggcacggcctcaagctgttcgcgatcgcgcactttacgtgcggcgaggtgctcgcaaccatgttcattgtgaaccacgtcatcgagggcgtctcgtacgcttccaaggacgcggtcaagggcacgatggcgccgccgaagacgatgcacggcgtgacgcccatgaacaacacgcgcaaggaggtggaggcggaggcgtccaagtctggcgccgtggtcaagtcagtcccgctcgacgactgggccgccgtccagtgccagacctcggcgaactggagcgtcggctcgtggttctggaaccacttttccggcggtctcaaccaccagattgagcaccacctgttccccgggctcagccacgagacgtactaccacatccaggacgtcgttcagtccacctgcgccgagtacggcgtcccgtaccagcacgagccttcgctctggaccgcgtactggaagatgctcgagcacctccgtcggctcggcaatgaggagacccacgagtcctggcagcgcgctgcctga

SEQ ID NO: 80 - protein, 519 aa, Thraustochytrium sp
MTVGYDGEIPFEQVRAHNKPDDAWCAIHGHVYDVTKFASVHPGGDIILLAAGKDATVLYETYHVRGVSDAVLRKYRIGKLPDGQGGANEKEKRTLSGLSSASYYTWNSDFYRVMRERVVARLKERGKARRGGYELWIKALLLLVGFWSSLCWMCTLDPSFGAILAAMSLGVFAAFVGTCIQHDGNHGAFAQSRWVNKVAGWTLDMIGASGMTWEFQHALGHHPYTNLIEEENGLQKVSGKKMDTKLADQESDPDVFSTYPMMRLHPWHQKRWYHRFQHIYGPFIFGFMTINKVVTQDVGVVFRKRLFQIDAECRYASPMYVARFWIMKALTVLYMVALPCYMQGPWHGLKLFAIAHFTCGEVLATMFIVNHVIEGVSYASKDAVKGTMAPPKTMHGVTPMNNTRKEVEAEASKSGAVVKSVPLDDWAAVQCQTSANWSVGSWFWNHFSGGLNHQIEHHLFPGLSHETYYHIQDVVQSTCAEYGVPYQHEPSLWTAYWKMLEHLRRLGNEETHESWQRAA

SEQ ID NO: 81 - DNA, 1653 bp, Thalassiosira pseudonana
  CDS (1)..(1653)
atgggcaacggcaacctcccagcatccaccgcacagctcaagtccacctcgaagccccagcagcaacatgagcatcgcaccatctccaagtccgagctcgcccaacacaacacgcccaaatcagcatggtgtgccgtccactccactcccgccaccgacccatcccactccaacaacaaacaacacgcacacctagtcctcgacattaccgactttgcgtcccgccatccagggggagacctcatcctcctcgcttccggcaaagacgcctcggtgctgtttgaaacataccatccacgtggagttccgacgtctctcattcaaaagctgcagattggagtgatggaggaggaggcgtttcgggattcgttttacagttggactgattctgacttttatactgtgttgaagaggagggttgtggagcggttggaggagagggggttggacaggaggggatcgaaagagatttggatcaaggctttgttcttgttggttggattttggtactgtttgtacaagatgtatactacgtcggatattgatcagtacggtattgccattgcctattctattggaatgggaacctttgcggcattcatcggcacgtgtattcaacacgatggaaatcacggtgcattcgctcagaacaagttactcaacaagttggctgggtggacgttggatatgattggtgcgagtgcgtttacgtgggagcttcagcacatgctggggcatcatccatatacgaatgtgttggatggggtggaggaggagaggaaggagaggggggaggatgttgctttggaagaaaaggatcaggaatcagatccagacgtattctcctccttccctctcatgagaatgcatccccaccatacaacctcatggtatcataaataccaacacctctacgctccacccctctttgcattgatgacacttgccaaagtattccaacaggattttgaagttgccacatccggacgattatatcatattgatgccaatgtacgttatggttcggtatggaatgtcatgaggttttgggctatgaaggtcattacgatgggatatatgatgggattaccaatctactttcatggagtactgaggggagttggattgtttgttattgggcatttggcgtgtggagagttgttggcgacgatgtttattgtgaatcacgtcattgagggtgtgagttatggaacgaaggatttggttggtggtgcgagtcatggagatgagaagaagattgtcaagccaacgactgtattgggagatacaccaatggaaaagactcgcgaggaggcattgaaaagcaacagcaataacaacaagaagaagggagagaagaactcggtaccatccgttccattcaacgactgggcagcagtccaatgccagacctccgtgaattggtctccaggctcatggttctggaatcacttttctgggggactctctcatcagattgagcatcacttgttccccagcatttgtcatacaaactactgtcatatccaggatgttgtggagagtacgtgtgctgagtacggagttccgtatcagagtgagagtaatttgtttgttgcttatggaaagatgattagtcatttgaagtttttgggtaaagccaagtgtgagtag

SEQ ID NO: 82 - protein, 550 aa, Thalassiosira pseudonana
MGNGNLPASTAQLKSTSKPQQQHEHRTISKSELAQHNTPKSAWCAVHSTPATDPSHSNNKQHAHLVLDITDFASRHPGGDLILLASGKDASVLFETYHPRGVPTSLIQKLQIGVMEEEAFRDSFYSWTDSDFYTVLKRRVVERLEERGLDRRGSKEIWIKALFLLVGFWYCLYKMYTTSDIDQYGIAIAYSIGMGTFAAFIGTCIQHDGNHGAFAQNKLLNKLAGWTLDMIGASAFTWELQHMLGHHPYTNVLDGVEEERKERGEDVALEEKDQESDPDVFSSFPLMRMHPHHTTSWYHKYQHLYAPPLFALMTLAKVFQQDFEVATSGRLYHIDANVRYGSVWNVMRFWAMKVITMGYMMGLPIYFHGVLRGVGLFVIGHLACGELLATMFIVNHVIEGVSYGTKDLVGGASHGDEKKIVKPTTVLGDTPMEKTREEALKSNSNNNKKKGEKNSVPSVPFNDWAAVQCQTSVNWSPGSWFWNHFSGGLSHQIEHHLFPSICHTNYCHIQDVVESTCAEYGVPYQSESNLFVAYGKMISHLKFLGKAKCE

SEQ ID NO: 83 - DNA, 1626 bp, Euglena gracilis
  CDS (1)..(1626)
atgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccacccgtccagctggacccccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcatcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgatggcaaccacggcgcgttcagccgcaacacactggtgaaccgcctggcggggtggggcatggacttgatcggcgcgtcgtccacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgctcaccttgtgtcgggggagtacctcgcgatctgcttcatcatcaaccacatcagcgagtcttgtgagtttatgaatacaagctttcaaaccgccgcccggaggacagagatgcttcaggcagcacatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccaccatcgcccctgttgtgaaggaggtgtgcgaggagtacgggttgccgtacaagaattacgtcacgttctgggatgcagtctgtggcatggttcagcacctccggttgatgggtgctccaccggtgccaacgaacggggacaaaaagtcataa

SEQ ID NO: 84 - protein, 541 aa, Euglena gracilis
MLVLFGNFYVKQYSQKNGKPENGATPENGAKPQPCENGTVEKRENDTANVRPTRPAGPPPATYYDSLAVSGQGKERLFTTDEVRRHILPTDGWLTCHEGVYDVTDFLAKHPGGGVITLGLGRDCTILIESYHPAGRPDKVMEKYRIGTLQDPKTFYAWGESDFYPELKRRALARLKEAGQARRGGLGVKALLVLTLFFVSWYMWVAHKSFLWAAVWGFAGSHVGLSIQHDGNHGAFSRNTLVNRLAGWGMDLIGASSTVWEYQHVIGHHQYTNLVSDTLFSLPENDPDVFSSYPLMRMHPDTAWQPHHRFQHLFAFPLFALMTISKVLTSDFAVCLSMKKGSIDCSSRLVPLEGQLLFWGAKLANFLLQIVLPCYLHGTAMGLALFSVAHLVSGEYLAICFIINHISESCEFMNTSFQTAARRTEMLQAAHQAAEAKKVKPTPPPNDWAVTQVQCCVNWRSGGVLANHLSGGLNHQIEHHLFPSISHANYPTIAPVVKEVCEEYGLPYKNYVTFWDAVCGMVQHLRLMGAPPVPTNGDKKS

SEQ ID NO: 85 - DNA, 1548 bp, Thraustochytrium aureum
  CDS (1)..(1548)
atgacggtcgggtttgacgaaacggtgactatggacacggtccgcaaccacaacatgccggacgacgcctggtgcgcgatccacggcaccgtgtacgacatcaccaagttcagcaaggtgcaccccggcggggacatcatcatgctggccgctggcaaggaggccaccatcctgttcgagacctaccacatcaagggcgtcccggacgcggtgctgcgcaagtacaaggtcggcaagctcccccagggcaagaagggcgaaacgagccacatgcccaccgggctcgactcggcctcctactactcgtgggacagcgagttttacagggtgctccgcgagcgcgtcgccaagaagctggccgagcccggcctcatgcagcgcgcgcgcatggagctctgggccaaggcgatcttcctcctggcaggtttctggggctccctttacgccatgtgcgtgctagacccgcacggcggtgccatggtagccgccgttacgctcggcgtgttcgctgcctttgtcggaacttgcatccagcacgacggcagccacggcgccttctccaagtcgcgattcatgaacaaggcggcgggctggaccctcgacatgatcggcgcgagtgcgatgacctgggagatgcagcacgttcttggccaccacccgtacaccaacctcatcgagatggagaacggtttggccaaggtcaagggcgccgacgtcgacccgaagaaggtcgaccaggagagcgacccggacgtcttcagtacgtacccgatgcttcgcctgcacccgtggcaccgccagcggttttaccacaagttccagcacctgtacgccccgtttatctttgggtctatgacgattaacaaggtgatttcccaggatgtcggggttgtgctgcgcaagcgcctgttccagatcgacgccaactgccggtatggcagcccctggtacgtggcccgcttctggatcatgaagctcctcaccacgctctacatggtggcgcttcccatgtacatgcaggggcctgctcagggcttgaagcttttcttcatggcccacttcacctgcggagaggtcctcgccaccatgtttattgtcaaccacatcatcgagggcgtcagctacgcttccaaggacgcggtcaagggcgtcatggctccgccgcgcactgtgcacggtgtcaccccgatgcaggtgacgcaaaaggcgctcagtgcggccgagtcggccaagtcggacgccgacaagacgaccatgatccccctcaacgactgggccgctgtgcagtgccagacctctgtgaactgggctgtcgggtcgtggttttggaaccacttttcgggcggcctcaaccaccagattgagcaccactgcttcccccaaaacccccacacggtcaacgtctacatctcgggcatcgtcaaggagacctgcgaagaatacggcgtgccgtaccaggctgagatcagcctcttctctgcctatttcaagatgctgtcgcacctccgcacgctcggcaacgaggacctcacggcctggtccacgtga

SEQ ID NO: 86 - protein, 515 aa, Thraustochytrium aureum
MTVGFDETVTMDTVRNHNMPDDAWCAIHGTVYDITKFSKVHPGGDIIMLAAGKEATILFETYHIKGVPDAVLRKYKVGKLPQGKKGETSHMPTGLDSASYYSWDSEFYRVLRERVAKKLAEPGLMQRARMELWAKAIFLLAGFWGSLYAMCVLDPHGGAMVAAVTLGVFAAFVGTCIQHDGSHGAFSKSRFMNKAAGWTLDMIGASAMTWEMQHVLGHHPYTNLIEMENGLAKVKGADVDPKKVDQESDPDVFSTYPMLRLHPWHRQRFYHKFQHLYAPFIFGSMTINKVISQDVGVVLRKRLFQIDANCRYGSPWYVARFWIMKLLTTLYMVALPMYMQGPAQGLKLFFMAHFTCGEVLATMFIVNHIIEGVSYASKDAVKGVMAPPRTVHGVTPMQVTQKALSAAESAKSDADKTTMIPLNDWAAVQCQTSVNWAVGSWFWNHFSGGLNHQIEHHCFPQNPHTVNVYISGIVKETCEEYGVPYQAEISLFSAYFKMLSHLRTLGNEDLTAWST

SEQ ID NO: 87 - DNA, 1548 bp, Thraustochytrium aureum
  CDS (1)..(1548)
atgacggtcgggtttgacgaaacggtgactatggacacggtccgcaaccacaacatgccggacgacgcctggtgcgcgatccacggcaccgtgtacgacatcaccaagttcagcaaggtgcaccccggcggggacatcatcatgctggccgctggcaaggaggccaccatcctgttcgagacgtaccacatcaagggcgttccggacgcggtgctgcgcaagtacaaggtcggcaagctcccccagggcaagaagggcgaaacgagccacatgcccaccgggctcgactcggccttctactactcgtgggacagcgagttttacagggtgctccgcgagcgcgtcgccaagaagctggccgagcccggcctcatgcagcgcgcgcgcatggagctctgggccaaggcgatcttcctcctggcaggtttctggggctccctttacgccatgtgcgtgctagacccgcacggcggtgccatggtagccgccgttacgctcggcgtgttcgctgcctttgtcggaacttgcatccagcacgacggcagccacggcgccttctccaagtcgcgattcatgaacaaggcggcgggctggaccctcgacatgatcggcgcgagcgcgatgacctgggagatgcagcacgttcttggccaccacccgtacaccaacctcatcgagatggagaacggtttggccaaggtcaagggcgccgacgtcgacccgaagaaggtcgaccaggagagcgacccggacgtcttcagtacgtacccgatgcttcgcctgcacccgtggcaccgccagcggttttaccacaagttccagcacctgtacgccccgtttatctttgggtttatgacgattaacaaggtgatttcccaggatgtcggggttgtgctgcgcaagcgcctgttccagatcgacgccaactgccggtatggcagcccctggtacgtggcccgcttctggatcatgaagctcctcaccacgctctacatggtggcgcttcccatgtacatgcaggggcctgctcagggcttgaagcttttcttcatggcccacttcacctgcggagaggtcctcgccaccatgtttattgtcaaccacatcatcgagggcgtcagctacgcttccaaggacgcggtcaagggcgtcatggctccgccgcgcactgtgcacggtgtcaccccgatgcaggtgacgcaaaaggcgctcagtgcggccgagtcgaccaagtcggacgccgacaagacgaccatgatccccctcaacgactgggccgctgtgcagtgccagacctctgtgaactgggctgtcgggtcgtggttttggaaccacttttcgggcggcctcaaccaccagattgagcaccactgcttcccccaaaacccccacacggtcaacgtctacatctcaggcatcgtcaaggagacctgcgaagaatacggcgtgccgtaccaggctgagatcagcctcttctctgcctatttcaagatgctgtcgcacctccgcacgctcggcaacgaggacctcacggcctggtccacgtga

SEQ ID NO: 88 - protein, 515 aa, Thraustochytrium aureum
MTVGFDETVTMDTVRNHNMPDDAWCAIHGTVYDITKFSKVHPGGDIIMLAAGKEATILFETYHIKGVPDAVLRKYKVGKLPQGKKGETSHMPTGLDSAFYYSWDSEFYRVLRERVAKKLAEPGLMQRARMELWAKAIFLLAGFWGSLYAMCVLDPHGGAMVAAVTLGVFAAFVGTCIQHDGSHGAFSKSRFMNKAAGWTLDMIGASAMTWEMQHVLGHHPYTNLIEMENGLAKVKGADVDPKKVDQESDPDVFSTYPMLRLHPWHRQRFYHKFQHLYAPFIFGFMTINKVISQDVGVVLRKRLFQIDANCRYGSPWYVARFWIMKLLTTLYMVALPMYMQGPAQGLKLFFMAHFTCGEVLATMFIVNHIIEGVSYASKDAVKGVMAPPRTVHGVTPMQVTQKALSAAESTKSDADKTTMIPLNDWAAVQCQTSVNWAVGSWFWNHFSGGLNHQIEHHCFPQNPHTVNVYISGIVKETCEEYGVPYQAEISLFSAYFKMLSHLRTLGNEDLTAWST

SEQ ID NO: 89 - DNA, 1548 bp, Thraustochytrium aureum
  CDS (1)..(1548)
atgacggtcgggtttgacgaaacggtgactatggacacggtccgcaaccacaacatgccggacgacgcctggtgcgcgatccacggcaccgtgtacgacatcaccaagttcagcaaggtgcaccccggcggggacatcatcatgctggccgctggcaaggaggccaccatcctgttcgagacgtaccacatcaagggcgtcccggacgcggtgctgcgcaagtacaaggtcggcaagctcccccagggcaagaagggcgaaacgagccacatgcccaccgggctcgactcggcctcctactactcgtgggacagcgagttttacagggtgctccgcgagcgcgtcgccaagaagctggccgagcccggcctcatgcagcgcgcgcgcatggagctctgggccaaggcgatcttcctcctggcaggtttctggggctccctttacgccatgtgcgtgctagacccgcacggcggtgccatggtagccgccgttacgctcggcgtgttcgctgcctttgtcggaacttgcatccagcacgacggcagccacggcgccttctccaagtcgcgattcatgaacaaggcggcgggctggaccctcgacatgatcggcgcgagcgcgatgacctgggagatgcagcacgttcttggccaccacccgtacaccaacctcatcgagatggagaacggtttggccaaggtcaagggcgccgacgtcgacccgaagaaggtcgaccaggagagcgacccggacgtcttcagtacgtacccgatgcttcgcctgcacccgtggcaccgccagcggttttaccacaagttccagcacctgtacgccccgtttatctttgggtttatgacgattaacaaggtgatttcccaggatgtcggggttgtgctgcgcaagcgcctgttccagatcgacgccaactgccggtatggcagcccctggtacgtggcccgcttctggatcatgaagctcctcaccacgctctacacggtggcgcttcccatgtacatgcaggggcctgctcagggcttgaagcttttcttcatggcccacttcacctgcggagaggtcctcgccaccatgtttattgtcaaccacatcatcgagggcgtcagctacgcttccaaggacgcggtcaagggcgtcatggctccgccgcgcactgtgcacggtgtcaccccgatgcaggtgacgcaaaaggcgctcagtgcggccgagtcgaccaagtcggacgccgacaagacgaccatgatccccctcaacgactgggccgctgtgcagtgccagacctctgtgaactgggctgtcgggtcgtggttttggaaccacttttcgggcggcctcaaccaccagattgagcaccactgcttcccccaaaacccccacacggtcaacgtctacatctcgggcatcgtcaaggagacctgcgaagaatacggcgtgccgtaccaggctgagatcagcctcttctctgcctatttcaagatgctgtcgcacctccgcacgctcggcaacgaggacctcacggccaggtccacgtga

SEQ ID NO: 90 - protein, 515 aa, Thraustochytrium aureum
MTVGFDETVTMDTVRNHNMPDDAWCAIHGTVYDITKFSKVHPGGDIIMLAAGKEATILFETYHIKGVPDAVLRKYKVGKLPQGKKGETSHMPTGLDSASYYSWDSEFYRVLRERVAKKLAEPGLMQRARMELWAKAIFLLAGFWGSLYAMCVLDPHGGAMVAAVTLGVFAAFVGTCIQHDGSHGAFSKSRFMNKAAGWTLDMIGASAMTWEMQHVLGHHPYTNLIEMENGLAKVKGADVDPKKVDQESDPDVFSTYPMLRLHPWHRQRFYHKFQHLYAPFIFGFMTINKVISQDVGVVLRKRLFQIDANCRYGSPWYVARFWIMKLLTTLYTVALPMYMQGPAQGLKLFFMAHFTCGEVLATMFIVNHIIEGVSYASKDAVKGVMAPPRTVHGVTPMQVTQKALSAAESTKSDADKTTMIPLNDWAAVQCQTSVNWAVGSWFWNHFSGGLNHQIEHHCFPQNPHTVNVYISGIVKETCEEYGVPYQAEISLFSAYFKMLSHLRTLGNEDLTARST

SEQ ID NO: 91 - DNA, 1548 bp, Thraustochytrium aureum
  CDS (1)..(1548)
atgacggtcgggtttgacgaaacggtgactatggacacggtccgcaaccacaacatgccggacgacgcctggtgcgcgatccacggcaccgtgtacgacatcaccaagttcagcaaggtgcaccccggcggggacatcatcatgctggccgctggcaaggaggccaccatcctgttcgagacctaccacatcaagggcgtcccggacgcggtgctgcgcaagtacaaggtcggcaagctcccccagggcaagaagggcgaaacgagccacatgcccaccgggctcgactcggcctcctactactcgtgggacagcgagttttacagggtgctccgcgagcgcgtcgccaagaagctggccgagcccggcctcatgcagcgcgcgcgcatggagctctgggccaaggcgatcttcctcctggcaggtttctggggctccctttacgccatgtgcgtgctagacccgcacggcggtgccatggtagccgccgttacgctcggcgtgttcgctgcctttgtcggaacttgcatccagcacgacggcagccacggcgccttctccaagtcgcgattcatgaacaaggcggcgggctggaccctcgacatgatcggcgcgagcgcgatgacctgggagatgcagcacgttcttggtcaccacccgtacaccaacctcatcgagatggagaacggtttggccaaggtcaagggcgccgacgtcgacccgaagaaggtcgaccaggagagcgacccggacgtcttcagtacgtacccgatgcttcgcctgcacccgtggcaccgccagcggttttaccacaagttccagcacctgtacgccccgcttatctttgggtttatgacgattaacaaggtgatttcccaggatgtcggggttgtgctgcgcaagcgcctgttccagatcgacgccaactgccggtatggcagcccctggaacgtggcccgcttctggatcatgaagctcctcaccacgctctacatggtggcgcttcccatgtacatgcaggggcctgctcagggcttgaagcttttcttcatggcccacttcacctgcggagaggtcctcgccaccatgtttattgtcaaccacatcatcgagggcgtcagctacgcttccaaggacgcggtcaagggcgtcatggctccgccgcgcactgtgcacggtgtcaccccgatgcaggtgacgcaaaaggcgctcagtgcggccgagtcgaccaagtcggacgccgacaagacgaccatgatccccctcaacgactgggccgctgtgcagtgccagacctctgtgaactgggctgtcgggtcgtggttttggaaccacttttcgggcggcctaaaccaccagattgagcaccactgcttcccccaaaacccccacacggtcaacgtctacatctcgggcatcgtcaaggagacctgcgaagaatacggcgtgccgtaccaggctgagatcagcctcttctctgcctatttcaagatgctgtcgcacctccgcacgctcggcaacgaggacctcacggcctggtccacgtga

SEQ ID NO: 92 - protein, 515 aa, Thraustochytrium aureum
MTVGFDETVTMDTVRNHNMPDDAWCAIHGTVYDITKFSKVHPGGDIIMLAAGKEATILFETYHIKGVPDAVLRKYKVGKLPQGKKGETSHMPTGLDSASYYSWDSEFYRVLRERVAKKLAEPGLMQRARMELWAKAIFLLAGFWGSLYAMCVLDPHGGAMVAAVTLGVFAAFVGTCIQHDGSHGAFSKSRFMNKAAGWTLDMIGASAMTWEMQHVLGHHPYTNLIEMENGLAKVKGADVDPKKVDQESDPDVFSTYPMLRLHPWHRQRFYHKFQHLYAPLIFGFMTINKVISQDVGVVLRKRLFQIDANCRYGSPWNVARFWIMKLLTTLYMVALPMYMQGPAQGLKLFFMAHFTCGEVLATMFIVNHIIEGVSYASKDAVKGVMAPPRTVHGVTPMQVTQKALSAAESTKSDADKTTMIPLNDWAAVQCQTSVNWAVGSWFWNHFSGGLNHQIEHHCFPQNPHTVNVYISGIVKETCEEYGVPYQAEISLFSAYFKMLSHLRTLGNEDLTAWST

SEQ ID NO: 93 - DNA, 1560 bp, Thraustochytrium sp
  CDS (1)..(1560)
atgacggtcggctacgacgaggagatcccgttcgagcaggtccgcgcgcacaacaagccggatgacgcctggtgcgcgatccacgggcacgtgtacgatgtgaccaagttcgcgagcgtgcacccgggcggcgacattatcctgctggccgcaggcaaggaggccaccgtgctgtacgagacttaccatgtgcggggcgtctcggacgcggtgctgcgcaagtaccgcatcggcaagctgccggacggccaaggcggcgcgaacgagaaggaaaagcggacgctctcgggcctctcgtcggcctcgtactacacgtggaacagcgacttttacagggtaatgcgcgagcgcgtcgtggctcggctcaaggagcgcggcaaggcccgccgcggaggctacgagctctggatcaaggcgttcctgctgctcgtcggcttctggagctcgctgtactggatgtgcacgctggacccctcgttcggggccatcctggccgccatgtcgctgggcgtctttgccgcctttgtgggcacgtgcatccagcacgacggcaaccacggcgcctttgcccagtcgcgatgggtcaacaaggttgccgggtggacgctcgacatgatcggcgccagcggcatgacgtgggagttccagcacgtcctgggccaccatccgtacacgaacctgatcgaggaggagaacggcctgcaaaaggtgagcggcaagaagatggacaccaagctggccgaccaggagagcgatccggacgtcttttccacgtacccgatgatgcgcctgcacccgtggcaccagaagcgctggtaccaccgtttccagcacatttacggccccttcatctttggcttcatgaccatcaacaaggtggtcacgcaggacgtcggtgtggtgctccgcaagcggctcttccagattgacgccgagtgccggtacgcgagcccaatgtacgtggcgcgtttctggatcatgaaggcgctcacggtgctctacatggtggccctgccgtgctacatgcagggcccgtggcacggcctcaagctgttcgcgatcgcgcactttacgtgcggcgaggtgctcgcaaccatgttcattgtgaaccacatcatcgagggcgtctcgtacgcttccaaggacgcggtcaagggcacgatggcgccgccgaagacgatgcacggcgtgacgcccatgaacaacacgcgcaaggaggtggaggcggaggcgtccaagtctggcgccgtggtcaagtcagtcccgctcgacgactgggccgtcgtccagtgccagacctcggtgaactggagcgtcggctcgtggttctggaatcacttttccggcggcctcaaccaccagattgagcaccacctgttccccggrctcagccacgagacgtactaccacattcaggacgtctttcagtccacctgcgccgagtacggcgtcccgtaccagcacgagccttcgctctggaccgcgtactggaagatgctcgagcacctccgtcagctcggcaatgaggagacccacgagtcctggcagcgcgctgcctga

SEQ ID NO: 94 - protein, 519 aa, Thraustochytrium sp
MTVGYDEEIPFEQVRAHNKPDDAWCAIHGHVYDVTKFASVHPGGDIILLAAGKEATVLYETYHVRGVSDAVLRKYRIGKLPDGQGGANEKEKRTLSGLSSASYYTWNSDFYRVMRERVVARLKERGKARRGGYELWIKAFLLLVGFWSSLYWMCTLDPSFGAILAAMSLGVFAAFVGTCIQHDGNHGAFAQSRWVNKVAGWTLDMIGASGMTWEFQHVLGHHPYTNLIEEENGLQKVSGKKMDTKLADQESDPDVFSTYPMMRLHPWHQKRWYHRFQHIYGPFIFGFMTINKVVTQDVGVVLRKRLFQIDAECRYASPMYVARFWIMKALTVLYMVALPCYMQGPWHGLKLFAIAHFTCGEVLATMFIVNHIIEGVSYASKDAVKGTMAPPKTMHGVTPMNNTRKEVEAEASKSGAVVKSVPLDDWAVVQCQTSVNWSVGSWFWNHFSGGLNHQIEHHLFPGLSHETYYHIQDVFQSTCAEYGVPYQHEPSLWTAYWKMLEHLRQLGNEETHESWQRAA

SEQ ID NO: 95 - protein, 575 aa, Artificial sequence
  Amino acid sequence obtainable by alignment of SEQ ID No. 78, 80, 82, 84, 86, 88, 90, 92, and/or 94
  Variant (2)..(3): Xaa in position 2 to 3 is any amino acid
  Variant (5)..(13): Xaa in position 5 to 13 is any amino acid
  Variant (14)..(48): Xaa in position 14 to 48 is any or no amino acid
  Variant (51)..(51): Xaa in position 51 is any amino acid
  Variant (54)..(54): Xaa in position 54 is any amino acid
  Variant (56)..(56): Xaa in position 56 is any amino acid
  Variant (62)..(62): Xaa in position 62 is any amino acid
  Variant (64)..(65): Xaa in position 64 to 65 is any amino acid
  Variant (66)..(81): Xaa in position 66 to 81 is any or no amino acid
  Variant (85)..(85): Xaa in position 85 is any amino acid
  Variant (87)..(87): Xaa in position 87 is any amino acid
  Variant (89)..(91): Xaa in position 89 to 91 is any amino acid
  Variant (97)..(97): Xaa in position 97 is any amino acid
  Variant (99)..(99): Xaa in position 99 is any amino acid
  Variant (102)..(102): Xaa in position 102 is any amino acid
  Variant (105)..(105): Xaa in position 105 is any amino acid
  Variant (108)..(108): Xaa in position 108 is any amino acid
  Variant (110)..(110): Xaa in position 110 is any amino acid
  Variant (115)..(116): Xaa in position 115 to 116 is any amino acid
  Variant (119)..(119): Xaa in position 119 is any amino acid
  Variant (121)..(121): Xaa in position 121 is any amino acid
  Variant (123)..(124): Xaa in position 123 to 124 is any amino acid
  Variant (127)..(128): Xaa in position 127 to 128 is any amino acid
  Variant (130)..(130): Xaa in position 130 is any amino acid
  Variant (132)..(137): Xaa in position 132 to 137 is any amino acid
  Variant (138)..(154): Xaa in position 138 to 154 is any or no amino acid
  Variant (156)..(156): Xaa in position 156 is any amino acid
  Variant (158)..(158): Xaa in position 158 is any amino acid
  Variant (159)..(159): Xaa in position 159 is any or no amino acid
  Variant (161)..(161): Xaa in position 161 is any amino acid
  Variant (164)..(164): Xaa in position 164 is any amino acid
  Variant (166)..(168): Xaa in position 166 to 168 is any amino acid
  Variant (171)..(173): Xaa in position 171 to 173 is any amino acid
  Variant (175)..(175): Xaa in position 175 is any amino acid
  Variant (177)..(177): Xaa in position 177 is any amino acid
  Variant (179)..(181): Xaa in position 179 to 181 is any amino acid
  Variant (183)..(184): Xaa in position 183 to 184 is any amino acid
  Variant (185)..(185): Xaa in position 185 is any or no amino acid
  Variant (189)..(189): Xaa in position 189 is any amino acid
  Variant (192)..(193): Xaa in position 192 to 193 is any amino acid
  Variant (196)..(196): Xaa in position 196 is any amino acid
  Variant (200)..(200): Xaa in position 200 is any amino acid
  Variant (204)..(204): Xaa in position 204 is any amino acid
  Variant (206)..(207): Xaa in position 206 to 207 is any amino acid
  Variant (208)..(211): Xaa in position 208 to 211 is any or no amino acid
  Variant (213)..(214): Xaa in position 213 to 214 is any amino acid
  Variant (215)..(216): Xaa in position 215 to 216 is any or no amino acid
  Variant (218)..(220): Xaa in position 218 to 220 is any amino acid
  Variant (222)..(224): Xaa in position 222 to 224 is any amino acid
  Variant (226)..(226): Xaa in position 226 is any amino acid
  Variant (240)..(240): Xaa in position 240 is any amino acid
  Variant (245)..(250): Xaa in position 245 to 250 is any amino acid
  Variant (253)..(253): Xaa in position 253 is any amino acid
  Variant (265)..(266): Xaa in position 265 to 266 is any amino acid
  Variant (270)..(270): Xaa in position 270 is any amino acid
  Variant (273)..(273): Xaa in position 273 is any amino acid
  Variant (283)..(284): Xaa in position 283 to 284 is any amino acid
  Variant (285)..(290): Xaa in position 285 to 290 is any or no amino acid
  Variant (292)..(293): Xaa in position 292 to 293 is any amino acid
  Variant (295)..(297): Xaa in position 295 to 297 is any amino acid
  Variant (299)..(302): Xaa in position 299 to 302 is any amino acid
  Variant (313)..(313): Xaa in position 313 is any amino acid
  Variant (316)..(317): Xaa in position 316 to 317 is any amino acid
  Variant (319)..(319): Xaa in position 319 is any amino acid
  Variant (322)..(322): Xaa in position 322 is any amino acid
  Variant (324)..(327): Xaa in position 324 to 327 is any amino acid
  Variant (330)..(330): Xaa in position 330 is any amino acid
  Variant (334)..(334): Xaa in position 334 is any amino acid
  Variant (336)..(336): Xaa in position 336 is any amino acid
  Variant (338)..(339): Xaa in position 338 to 339 is any amino acid
  Variant (341)..(342): Xaa in position 341 to 342 is any amino acid
  Variant (346)..(346): Xaa in position 346 is any amino acid
  Variant (349)..(350): Xaa in position 349 to 350 is any amino acid
  Variant (353)..(354): Xaa in position 353 to 354 is any amino acid
  Variant (356)..(359): Xaa in position 356 to 359 is any amino acid
  Variant (362)..(363): Xaa in position 362 to 363 is any amino acid
  Variant (367)..(368): Xaa in position 367 to 368 is any amino acid
  Variant (371)..(371): Xaa in position 371 is any amino acid
  Variant (373)..(375): Xaa in position 373 to 375 is any amino acid
  Variant (377)..(377): Xaa in position 377 is any amino acid
  Variant (381)..(381): Xaa in position 381 is any amino acid
  Variant (384)..(385): Xaa in position 384 to 385 is any amino acid
  Variant (387)..(387): Xaa in position 387 is any amino acid
  Variant (390)..(392): Xaa in position 390 to 392 is any amino acid
  Variant (395)..(395): Xaa in position 395 is any amino acid
  Variant (397)..(398): Xaa in position 397 to 398 is any amino acid
  Variant (400)..(402): Xaa in position 400 to 402 is any amino acid
  Variant (405)..(405): Xaa in position 405 is any amino acid
  Variant (408)..(409): Xaa in position 408 to 409 is any amino acid
  Variant (412)..(413): Xaa in position 412 to 413 is any amino acid
  Variant (417)..(417): Xaa in position 417 is any amino acid
  Variant (427)..(427): Xaa in position 427 is any amino acid
  Variant (434)..(435): Xaa in position 434 to 435 is any amino acid
  Variant (438)..(438): Xaa in position 438 is any amino acid
  Variant (440)..(440): Xaa in position 440 is any amino acid
  Variant (442)..(443): Xaa in position 442 to 443 is any amino acid
  Variant (444)..(452): Xaa in position 444 to 452 is any or no amino acid
  Variant (454)..(454): Xaa in position 454 is any amino acid
  Variant (456)..(457): Xaa in position 456 to 457 is any amino acid
  Variant (459)..(459): Xaa in position 459 is any amino acid
  Variant (463)..(464): Xaa in position 463 to 464 is any amino acid
  Variant (466)..(466): Xaa in position 466 is any amino acid
  Variant (468)..(472): Xaa in position 468 to 472 is any amino acid
  Variant (473)..(473): Xaa in position 473 is any or no amino acid
  Variant (475)..(483): Xaa in position 475 to 483 is any amino acid
  Variant (484)..(489): Xaa in position 484 to 489 is any or no amino acid
  Variant (491)..(492): Xaa in position 491 to 492 is any amino acid
  Variant (496)..(496): Xaa in position 496 is any amino acid
  Variant (506)..(507): Xaa in position 506 to 507 is any amino acid
  Variant (527)..(527): Xaa in position 527 is any amino acid
  Variant (530)..(532): Xaa in position 530 to 532 is any amino acid
  Variant (534)..(538): Xaa in position 534 to 538 is any amino acid
  Variant (540)..(542): Xaa in position 540 to 542 is any amino acid
  Variant (544)..(545): Xaa in position 544 to 545 is any amino acid
  Variant (548)..(548): Xaa in position 548 is any amino acid
  Variant (556)..(556): Xaa in position 556 is any amino acid
  Variant (558)..(559): Xaa in position 558 to 559 is any amino acid
  Variant (561)..(562): Xaa in position 561 to 562 is any amino acid
  Variant (565)..(565): Xaa in position 565 is any amino acid
  Variant (568)..(569): Xaa in position 568 to 569 is any amino acid
  Variant (573)..(573): Xaa in position 573 is any amino acid
MXXGXXXXXXXXXXXXXXXXXXXXXXXXXXXXXXXXXXXXXXXXXXXXVRXHNXPXDAWCAXHXXXXXXXXXXXXXXXXXXVYDXTXFXXXHPGGDXIXLAXGKXATXLXETYHXXGVXDXVXXKYXXGXLXXXXXXXXXXXXXXXXXXXXXXXYXWXXSXFYXVXXXRVXXXLXEXGXXXRXXXELWXKAXXLLXGFWXSLYXMXXXXXXDXXXXAXXXAXXXGXFAAFVGTCIQHDGXHGAFXXXXXXNKXAGWTLDMIGASXXTWEXQHXLGHHPYTNLXXXXXXXXKXXGXXXDXXXXDQESDPDVFSXYPXXRXHPXHXXXXYHXFQHXYXPXXFXXMTIXKVXXQDXXVXXXXRLXXIDAXXRYXSXXXVXRFWXMKXXTXLYXXXLPXYXXGXXXGLXLFXXAHXXCGEXLATMFIVNHXIEGVSYXXKDXVXGXXXXXXXXXXXPXTXXGXTPMXXTXKXXXXXXSXXXXXXXXXXXXXXXPXXDWAXVQCQTSVNWXXGSWFWNHFSGGLNHQIEHHXFPXXXHXXXXXIXXXVXXTCXEYGVPYQXEXXLXXAYXKMXXHLRXLG

SEQ ID NO: 96 - protein, 58 aa, Artificial sequence
  Amino acid sequence obtainable by alignment of SEQ ID No. 78, 80, 82, 84, 86, 88, 90, 92, and/or 94
  Variant (2)..(4): Xaa in position 2 to 4 is any amino acid
  Variant (10)..(10): Xaa in position 10 is Ala or Val
  Variant (13)..(13): Xaa in position 13 is Ala or Ser
  Variant (14)..(14): Xaa in position 14 is Pro or Val
  Variant (27)..(27): Xaa in position 27 is Asn or Ser
  Variant (34)..(34): Xaa in position 34 is any amino acid
  Variant (37)..(37): Xaa in position 37 is Gly, Gln or Ser
  Variant (38)..(39): Xaa in position 38 to 39 is any amino acid
  Variant (41)..(41): Xaa in position 41 is Glu or Thr
  Variant (42)..(42): Xaa in position 42 is Asn, Thr or Val
  Variant (43)..(44): Xaa in position 43 to 44 is any amino acid
  Variant (45)..(45): Xaa in position 45 is His or Tyr
  Variant (47)..(47): Xaa in position 47 is Gln or Ser
  Variant (48)..(48): Xaa in position 48 is Asp or Gly
  Variant (49)..(49): Xaa in position 49 is Ile or Val
  Variant (50)..(50): Xaa in position 50 is Phe or Val
  Variant (51)..(51): Xaa in position 51 is any amino acid
  Variant (52)..(52): Xaa in position 52 is Glu or Ser
  Variant (55)..(55): Xaa in position 55 is Ala or Glu
WXXXQCQTSXNWXXGSWFWNHFSGGLXHQIEHHXFPXXXHXXXXXIXXXXXXTCXEYG

SEQ ID NO: 97 - protein, 61 aa, Artificial sequence
  Amino acid sequence obtainable by alignment of SEQ ID No. 78, 80, 82, 84, 86, 88, 90, 92, and/or 94
  Variant (2)..(2): Xaa in position 2 is any amino acid
  Variant (7)..(7): Xaa in position 7 is Ile or Val
  Variant (16)..(16): Xaa in position 16 is Asn or Ser
  Variant (21)..(21): Xaa in position 21 is Ala or Ser
  Variant (22)..(22): Xaa in position 22 is any amino acid
  Variant (23)..(23): Xaa in position 23 is Asn or Ser
  Variant (24)..(24): Xaa in position 24 is Lys or Arg
  Variant (25)..(25): Xaa in position 25 is any amino acid
  Variant (26)..(26): Xaa in position 26 is Leu, Met or Val
  Variant (29)..(29): Xaa in position 29 is any or no amino acid
  Variant (31)..(31): Xaa in position 31 is any or no amino acid
  Variant (42)..(42): Xaa in position 42 is Ala or Gly
  Variant (43)..(43): Xaa in position 43 is Phe or Met
  Variant (47)..(47): Xaa in position 47 is Phe, Leu or Met
  Variant (50)..(50): Xaa in position 50 is any amino acid
  Variant (59)..(59): Xaa in position 59 is Leu or Val
  Variant (60)..(60): Xaa in position 60 is Ile or Leu
  Variant (61)..(61): Xaa in position 61 is Asp or Glu
GXFAAFXGTCIQHDGXHGAFXXXXXXNKXAXGWTLDMIGASXXTWEXQHXLGHHPYTNXXX

SEQ ID NO: 98 - protein, 40 aa, Artificial sequence
  Amino acid sequence obtainable by alignment of SEQ ID No. 78, 80, 82, 84, 86, 88, 90, 92, and/or 94
  Variant (3)..(3): Xaa in position 3 is Lys or Arg
  Variant (4)..(4): Xaa in position 4 is Phe or Tyr
  Variant (7)..(7): Xaa in position 7 is Ile or Leu
  Variant (9)..(9): Xaa in position 9 is Ala or Gly
  Variant (11)..(12): Xaa in position 11 to 12 is any or no amino acid
  Variant (14)..(15): Xaa in position 14 to 15 is any amino acid
  Variant (16)..(17): Xaa in position 16 to 17 is any or no amino acid
  Variant (20)..(20): Xaa in position 20 is Ile or Leu
  Variant (21)..(21): Xaa in position 21 is Ala or Asn
  Variant (24)..(24): Xaa in position 24 is Phe, Ile or Val
  Variant (25)..(25): Xaa in position 25 is Gln, Ser or Thr
  Variant (28)..(28): Xaa in position 28 is Phe or Val
  Variant (29)..(29): Xaa in position 29 is Glu or Gly
  Variant (31)..(31): Xaa in position 31 is Ala or Val
  Variant (32)..(32): Xaa in position 32 is any amino acid
  Variant (33)..(33): Xaa in position 33 is Arg or Ser
  Variant (34)..(34): Xaa in position 34 is any amino acid
  Variant (37)..(37): Xaa in position 37 is Phe or Tyr
  Variant (38)..(38): Xaa in position 38 is any amino acid
YHXXQHXYXPXXFXXXXMTXXKVXXQDXXVXXXXRLXXID

SEQ ID NO: 99 - protein, 59 aa, Artificial sequence
  Amino acid sequence obtainable by alignment of SEQ ID No. 78, 80, 82, 84, 86, 88, 90, 92, and/or 94
  Variant (3)..(3): Xaa in position 3 is Ala or Ile
  Variant (6)..(6): Xaa in position 6 is Ala, Leu or Val
  Variant (7)..(7): Xaa in position 7 is Ile or Leu
  Variant (9)..(9): Xaa in position 9 is any amino acid
  Variant (10)..(10): Xaa in position 10 is Gly or Leu
  Variant (12)..(12): Xaa in position 12 is any amino acid
  Variant (13)..(13): Xaa in position 13 is Met or Val
  Variant (14)..(14): Xaa in position 14 is Ala or Gly
  Variant (17)..(17): Xaa in position 17 is any amino acid
  Variant (19)..(19): Xaa in position 19 is Phe or Met
  Variant (20)..(20): Xaa in position 20 is any amino acid
  Variant (22)..(22): Xaa in position 22 is Pro or Val
  Variant (23)..(24): Xaa in position 23 to 24 is any amino acid
  Variant (26)..(26): Xaa in position 26 is Leu or Val
  Variant (27)..(27): Xaa in position 27 is any amino acid
  Variant (30)..(30): Xaa in position 30 is any amino acid
  Variant (31)..(31): Xaa in position 31 is Ile or Met
  Variant (32)..(32): Xaa in position 32 is Ala or Gly
  Variant (34)..(34): Xaa in position 34 is Phe or Leu
  Variant (35)..(35): Xaa in position 35 is Ala or Thr
  Variant (39)..(39): Xaa in position 39 is Leu or Val
  Variant (49)..(49): Xaa in position 49 is Ile or Val
  Variant (56)..(56): Xaa in position 56 is Ala or Gly
  Variant (57)..(57): Xaa in position 57 is Ser or Thr
FWXMKXXTXXYXXXLPXYXXGXXXGXXLFXXXHXXCGEXLATMFIVNHXIEGVSYXXKD

SEQ ID NO: 100 - protein, 45 aa, Artificial sequence
  Amino acid sequence obtainable by alignment of SEQ ID No. 78, 80, 82, 84, 86, 88, 90, 92, and/or 94
  Variant (3)..(3): Xaa in position 3 is Ile or Val
  Variant (5)..(5): Xaa in position 5 is Asp or Lys
  Variant (7)..(9): Xaa in position 7 to 9 is any amino acid
  Variant (14)..(14): Xaa in position 14 is Asp or Gly
  Variant (15)..(15): Xaa in position 15 is Ile or Val
  Variant (17)..(17): Xaa in position 17 is any amino acid
  Variant (19)..(19): Xaa in position 19 is Ala or Gly
  Variant (20)..(20): Xaa in position 20 is Ala or Leu
  Variant (22)..(22): Xaa in position 22 is Lys or Arg
  Variant (23)..(23): Xaa in position 23 is Asp or Glu
  Variant (24)..(24): Xaa in position 24 is Ala or Cys
  Variant (26)..(26): Xaa in position 26 is Ile or Val
  Variant (28)..(28): Xaa in position 28 is any amino acid
  Variant (30)..(30): Xaa in position 30 is Ser or Thr
  Variant (33)..(33): Xaa in position 33 is Ile, Pro or Val
  Variant (34)..(34): Xaa in position 34 is any amino acid
  Variant (36)..(36): Xaa in position 36 is any amino acid
  Variant (37)..(37): Xaa in position 37 is Pro or Ser
  Variant (39)..(39): Xaa in position 39 is any amino acid
  Variant (41)..(41): Xaa in position 41 is Leu or Met
  Variant (42)..(42): Xaa in position 42 is Glu or Arg
  Variant (45)..(45): Xaa in position 45 is Lys or Arg
YDXTXFXXXHPGGXXIXLXXGXXXTXLXEXYHXXGXXDXVXXKYX

SEQ ID NO: 101 - protein, 24 aa, Artificial sequence
  Amino acid sequence obtainable by alignment of SEQ ID No. 78, 80, 82, 84, 86, 88, 90, 92, and/or 94
  Variant (2)..(6): Xaa in position 2 to 6 is any or no amino acid
  Variant (16)..(16): Xaa in position 16 is Ser or Thr
  Variant (17)..(17): Xaa in position 17 is Phe or Tyr
  Variant (19)..(20): Xaa in position 19 to 20 is Leu or Met
  Variant (22)..(22): Xaa in position 22 is Leu or Met
DXXXXXQESDPDVFSXXPXXRXHP

SEQ ID NO: 102 - protein, 27 aa, Artificial sequence
  Amino acid sequence obtainable by alignment of SEQ ID No. 78, 80, 82, 84, 86, 88, 90, 92, and/or 94
  Variant (2)..(2): Xaa in position 2 is Asp or Glu
  Variant (5)..(5): Xaa in position 5 is any amino acid
  Variant (7)..(7): Xaa in position 7 is Leu or Met
  Variant (8)..(8): Xaa in position 8 is Lys or Arg
  Variant (9)..(9): Xaa in position 9 is Glu or Arg
  Variant (12)..(12): Xaa in position 12 is Ala or Val
  Variant (13)..(13): Xaa in position 13 is any amino acid
  Variant (14)..(14): Xaa in position 14 is Lys or Arg
  Variant (16)..(16): Xaa in position 16 is any amino acid
  Variant (18)..(18): Xaa in position 18 is any amino acid
  Variant (20)..(21): Xaa in position 20 to 21 is any amino acid
  Variant (22)..(22): Xaa in position 22 is Gln or Arg
  Variant (24)..(24): Xaa in position 24 is Ala or Gly
  Variant (25)..(26): Xaa in position 25 to 26 is any amino acid
SXFYXVXXXRVXXXLXEXGXXXRXXXE

SEQ ID NO: 103 - protein, 28 aa, Artificial sequence
  Amino acid sequence obtainable by alignment of SEQ ID No. 78, 80, 82, 84, 86, 88, 90, 92, and/or 94
  Variant (2)..(3): Xaa in position 2 to 3 is any amino acid
  Variant (4)..(4): Xaa in position 4 is any or no amino acid
  Variant (6)..(10): Xaa in position 6 to 10 is any amino acid
  Variant (11)..(12): Xaa in position 11 to 12 is any or no amino acid
  Variant (15)..(15): Xaa in position 15 is any amino acid
  Variant (17)..(18): Xaa in position 17 to 18 is any amino acid
  Variant (20)..(20): Xaa in position 20 is Asp or Thr
  Variant (22)..(22): Xaa in position 22 is Ala or Gly
  Variant (24)..(24): Xaa in position 24 is any amino acid
  Variant (25)..(25): Xaa in position 25 is Ala or Thr
  Variant (26)..(26): Xaa in position 26 is any amino acid
  Variant (28)..(28): Xaa in position 28 is Glu or Gly
GXXXEXXXXXXXVRXHXXPXDXWXXXHX

SEQ ID NO: 104 - protein, 28 aa, Artificial sequence
  Amino acid sequence obtainable by alignment of SEQ ID No. 78, 80, 82, 84, 86, 88, 90, 92, and/or 94
  Variant (5)..(5): Xaa in position 5 is any amino acid
  Variant (7)..(7): Xaa in position 7 is any or no amino acid
  Variant (9)..(9): Xaa in position 9 is any or no amino acid
  Variant (11)..(11): Xaa in position 11 is Phe or Trp
  Variant (12)..(12): Xaa in position 12 is Ser, Thr or Val
  Variant (15)..(15): Xaa in position 15 is any amino acid
  Variant (18)..(18): Xaa in position 18 is Ile or Leu
  Variant (19)..(19): Xaa in position 19 is Glu or Ser
  Variant (22)..(22): Xaa in position 22 is Lys or Arg
  Variant (23)..(23): Xaa in position 23 is any amino acid
  Variant (26)..(26): Xaa in position 26 is any amino acid
  Variant (27)..(27): Xaa in position 27 is Ala or Glu
  Variant (28)..(28): Xaa in position 28 is Asp, Glu or Lys
VPYQXEXSXLXXAYXKMXXHLXXLGXXX

SEQ ID NO: 105 - protein, 15 aa, Artificial sequence
  Amino acid sequence obtainable by alignment of SEQ ID No. 78, 80, 82, 84, 86, 88, 90, 92, and/or 94
  Variant (4)..(4): Xaa in position 4 is any amino acid
  Variant (5)..(5): Xaa in position 5 is Cys or Ser
  Variant (7)..(8): Xaa in position 7 to 8 is any amino acid
  Variant (10)..(12): Xaa in position 10 to 12 is any amino acid
  Variant (13)..(13): Xaa in position 13 is any or no amino acid
  Variant (15)..(15): Xaa in position 15 is Ile or Pro
GFWXXLXXMXXXXDX

SEQ ID NO: 106 - protein, 29 aa, Artificial sequence
  Amino acid sequence obtainable by alignment of SEQ ID No. 78, 80, 82, 84, 86, 88, 90, 92, and/or 94
  Variant (2)..(7): Xaa in position 2 to 7 is any amino acid
  Variant (8)..(12): Xaa in position 8 to 12 is any or no amino acid
  Variant (14)..(14): Xaa in position 14 is Asp or Val
  Variant (18)..(18): Xaa in position 18 is Glu, Asn or Gln
  Variant (19)..(19): Xaa in position 19 is any amino acid
  Variant (21)..(21): Xaa in position 21 is Gln or Arg
  Variant (22)..(22): Xaa in position 22 is Glu or Lys
  Variant (23)..(23): Xaa in position 23 is Ala or Glu
  Variant (24)..(24): Xaa in position 24 is Ala, Leu or Val
  Variant (25)..(26): Xaa in position 25 to 26 is any amino acid
  Variant (27)..(27): Xaa in position 27 is Ala, Glu or Ser
  Variant (28)..(28): Xaa in position 28 is Ala, Glu or Asn
VXXXXXXXXXXXGXTPMXXTXXXXXXXXS

SEQ ID NO: 107 - protein, 11 aa, Artificial sequence
  Amino acid sequence obtainable by alignment of SEQ ID No. 78, 80, 82, 84, 86, 88, 90, 92, and/or 94
  Variant (2)..(2): Xaa in position 2 is Glu or Asn
  Variant (3)..(3): Xaa in position 3 is Cys or Val
  Variant (6)..(6): Xaa in position 6 is Ala or Gly
  Variant (8)..(8): Xaa in position 8 is Pro or Val
  Variant (9)..(10): Xaa in position 9 to 10 is any amino acid
AXXRYXSXXXV

SEQ ID NO: 108 - protein, 8 aa, Artificial sequence
  Amino acid sequence obtainable by alignment of SEQ ID No. 78, 80, 82, 84, 86, 88, 90, 92, and/or 94
  Variant (2)..(2): Xaa in position 2 is Ala or Ile
  Variant (5)..(5): Xaa in position 5 is Phe, Ile or Leu
  Variant (6)..(6): Xaa in position 6 is Phe or Leu
WXKAXXLL

SEQ ID NO: 109 - DNA, 903 bp, Ostreococcus tauri
  CDS (1)..(903)
atgagcgcctccggtgcgctgctgcccgcgatcgcgttcgccgcgtacgcgtacgcgacgtacgcctacgcctttgagtggtcgcacgcgaatggcatcgacaacgtcgacgcgcgcgagtggatcggtgcgctgtcgttgaggctcccggcgatcgcgacgacgatgtacctgttgttctgcctggtcggaccgaggttgatggcgaagcgcgaggcgttcgacccgaaggggttcatgctggcgtacaatgcgtatcagacggcgttcaacgtcgtcgtgctcgggatgttcgcgcgagagatctcggggctggggcagcccgtgtgggggtcaaccatgccgtggagcgatagaaaatcgtttaagatcctcctcggggtgtggttgcactacaacaacaaatatttggagctattggacactgtgttcatggttgcgcgcaagaagacgaagcagttgagcttcttgcacgtttatcatcacgccctgttgatctgggcgtggtggttggtgtgtcacttgatggccacgaacgattgtatcgatgcctacttcggcgcggcgtgcaactcgttcattcacatcgtgatgtactcgtattatctcatgtcggcgctcggcattcgatgcccgtggaagcgatacatcacccaggctcaaatgctccaattcgtcattgtcttcgcgcacgccgtgttcgtgctgcgtcagaagcactgcccggtcacccttccttgggcgcaaatgttcgtcatgacgaacatgctcgtgctcttcgggaacttctacctcaaggcgtactcgaacaagtcgcgcggcgacggcgcgagttccgtgaaaccagccgagaccacgcgcgcgcccagcgtgcgacgcacgcgatctcgaaaaattgactaa

SEQ ID NO: 110 - protein, 300 aa, Ostreococcus tauri; identical to SEQ ID NO: 65

SEQ ID NO: 111 - DNA, 834 bp, Pavlova sp; identical to SEQ ID NO: 66
  CDS (1)..(834)

SEQ ID NO: 112 - protein, 277 aa, Pavlova sp; identical to SEQ ID NO: 67

SEQ ID NO: 113 - DNA, 1077 bp, Thalassiosira pseudonana; identical to SEQ ID NO: 68
  CDS (1)..(1077)

SEQ ID NO: 114 - protein, 358 aa, Thalassiosira pseudonana; identical to SEQ ID NO: 69

SEQ ID NO: 115 - DNA, 903 bp, Ostreococcus tauri; identical to SEQ ID NO: 70
  CDS (1)..(903)

SEQ ID NO: 116 - protein, 300 aa, Ostreococcus tauri; identical to SEQ ID NO: 71

SEQ ID NO: 117 - protein, 339 aa, Artificial sequence; identical to SEQ ID NO: 72
  Amino acid sequence obtainable by alignment of SEQ ID No. 110, 112, 114 and/or 116
  Variant (3)..(29): Xaa in position 3 to 29 is any amino acid
  Variant (30)..(43): Xaa in position 30 to 43 is any or no amino acid
  Variant (45)..(50): Xaa in position 45 to 50 is any amino acid
  Variant (53)..(73): Xaa in position 53 to 73 is any amino acid
  Variant (74)..(79): Xaa in position 74 to 79 is any or no amino acid
  Variant (81)..(82): Xaa in position 81 to 82 is any amino acid
  Variant (85)..(86): Xaa in position 85 to 86 is any amino acid
  Variant (88)..(90): Xaa in position 88 to 90 is any amino acid
  Variant (92)..(110): Xaa in position 92 to 110 is any amino acid
  Variant (112)..(127): Xaa in position 112 to 127 is any amino acid
  Variant (128)..(128): Xaa in position 128 is any or no amino acid
  Variant (130)..(130): Xaa in position 130 is any amino acid
  Variant (133)..(134): Xaa in position 133 to 134 is any amino acid
  Variant (137)..(137): Xaa in position 137 is any amino acid
  Variant (139)..(140): Xaa in position 139 to 140 is any amino acid
  Variant (143)..(144): Xaa in position 143 to 144 is any amino acid
  Variant (147)..(147): Xaa in position 147 is any amino acid
  Variant (149)..(149): Xaa in position 149 is any amino acid
  Variant (151)..(152): Xaa in position 151 to 152 is any amino acid
  Variant (154)..(154): Xaa in position 154 is any amino acid
  Variant (159)..(159): Xaa in position 159 is any amino acid
  Variant (163)..(166): Xaa in position 163 to 166 is any amino acid
  Variant (170)..(179): Xaa in position 170 to 179 is any amino acid
  Variant (180)..(182): Xaa in position 180 to 182 is any or no amino acid
  Variant (184)..(184): Xaa in position 184 is any amino acid
  Variant (188)..(190): Xaa in position 188 to 190 is any amino acid
  Variant (193)..(193): Xaa in position 193 is any amino acid
  Variant (196)..(197): Xaa in position 196 to 197 is any amino acid
  Variant (203)..(206): Xaa in position 203 to 206 is any amino acid
  Variant (208)..(210): Xaa in position 208 to 210 is any amino acid
  Variant (217)..(217): Xaa in position 217 is any amino acid
  Variant (222)..(223): Xaa in position 222 to 223 is any amino acid
  Variant (226)..(252): Xaa in position 226 to 252 is any amino acid
  Variant (253)..(267): Xaa in position 253 to 267 is any or no amino acid
  Variant (269)..(272): Xaa in position 269 to 272 is any amino acid
  Variant (276)..(277): Xaa in position 276 to 277 is any amino acid
  Variant (280)..(282): Xaa in position 280 to 282 is any amino acid
  Variant (284)..(291): Xaa in position 284 to 291 is any amino acid
  Variant (292)..(324): Xaa in position 292 to 324 is any or no amino acid
  Variant (326)..(337): Xaa in position 326 to 337 is any amino acid
  Variant (338)..(338): Xaa in position 338 is any or no amino acid

SEQ ID NO: 118 - protein, 45 aa, Artificial sequence; identical to SEQ ID NO: 73
  Amino acid sequence obtainable by alignment of SEQ ID No. 110, 112, 114 and/or 116
  Variant (4)..(4): Xaa in position 4 is Ala or Gly
  Variant (5)..(5): Xaa in position 5 is Ala or Leu
  Variant (6)..(6): Xaa in position 6 is any amino acid
  Variant (9)..(9): Xaa in position 9 is Phe or Ile
  Variant (12)..(12): Xaa in position 12 is any or no amino acid
  Variant (14)..(14): Xaa in position 14 is any or no amino acid
  Variant (20)..(20): Xaa in position 20 is any amino acid
  Variant (21)..(21): Xaa in position 21 is Leu or Met
  Variant (22)..(22): Xaa in position 22 is Ala or Ser
  Variant (23)..(23): Xaa in position 23 is Ala or Leu
  Variant (25)..(26): Xaa in position 25 to 26 is any amino acid
  Variant (27)..(27): Xaa in position 27 is Arg or Ser
  Variant (34)..(34): Xaa in position 34 is Ile or Leu
  Variant (39)..(39): Xaa in position 39 is Leu or Met
  Variant (40)..(40): Xaa in position 40 is Leu or Val
  Variant (43)..(43): Xaa in position 43 is Cys, Thr or Val
  Variant (44)..(44): Xaa in position 44 is any amino acid
  Variant (45)..(45): Xaa in position 45 is Cys or Val

SEQ ID NO: 119 - protein, 43 aa, Artificial sequence; identical to SEQ ID NO: 74
  Amino acid sequence obtainable by alignment of SEQ ID No. 110, 112, 114 and/or 116
  Variant (2)..(2): Xaa in position 2 is Leu or Val
  Variant (5)..(5): Xaa in position 5 is Cys or Asn
  Variant (6)..(6): Xaa in position 6 is Asp or Asn
  Variant (9)..(10): Xaa in position 9 to 10 is any or no amino acid
  Variant (12)..(12): Xaa in position 12 is any amino acid
  Variant (13)..(14): Xaa in position 13 to 14 is any or no amino acid
  Variant (17)..(17): Xaa in position 17 is any amino acid
  Variant (18)..(18): Xaa in position 18 is Phe or Trp
  Variant (21)..(21): Xaa in position 21 is Ala or Leu
  Variant (23)..(23): Xaa in position 23 is any amino acid
  Variant (25)..(26): Xaa in position 25 to 26 is any amino acid
  Variant (28)..(28): Xaa in position 28 is Leu or Val
  Variant (33)..(33): Xaa in position 33 is Ile or Val
  Variant (37)..(37): Xaa in position 37 is Ala, Thr or Val
  Variant (38)..(38): Xaa in position 38 is any amino acid
  Variant (39)..(39): Xaa in position 39 is Ile or Leu
  Variant (40)..(40): Xaa in position 40 is any amino acid

SEQ ID NO: 120 - protein, 37 aa, Artificial sequence; identical to SEQ ID NO: 75
  Amino acid sequence obtainable by alignment of SEQ ID No. 110, 112, 114 and/or 116
  Variant (2)..(3): Xaa in position 2 to 3 is any or no amino acid
  Variant (5)..(5): Xaa in position 5 is any or no amino acid
  Variant (9)..(9): Xaa in position 9 is Gly, Ser or Thr
  Variant (10)..(10): Xaa in position 10 is any amino acid
  Variant (13)..(14): Xaa in position 13 to 14 is any amino acid
  Variant (15)..(15): Xaa in position 15 is Ala or Ser
  Variant (17)..(17): Xaa in position 17 is Ala or Ser
  Variant (18)..(18): Xaa in position 18 is any amino acid
  Variant (19)..(19): Xaa in position 19 is Glu or Lys
  Variant (20)..(20): Xaa in position 20 is Ala, Asn or Ser
  Variant (21)..(21): Xaa in position 21 is Lys or Arg
  Variant (22)..(22): Xaa in position 22 is Ala, Gly or Ser
  Variant (23)..(23): Xaa in position 23 is any amino acid
  Variant (24)..(24): Xaa in position 24 is Glu or Gly
  Variant (25)..(29): Xaa in position 25 to 29 is any amino acid
  Variant (30)..(30): Xaa in position 30 is Asn, Pro or Gln
  Variant (31)..(32): Xaa in position 31 to 32 is Ala, Asp or Glu
  Variant (33)..(33): Xaa in position 33 is Gly, Ser or Thr
  Variant (34)..(34): Xaa in position 34 is Asn, Gln or Thr
  Variant (35)..(36): Xaa in position 35 to 36 is any amino acid
  Variant (37)..(37): Xaa in position 37 is Ala, Asp or Pro

SEQ ID NO: 121 - protein, 19 aa, Artificial sequence
  Amino acid sequence obtainable by alignment of SEQ ID No. 110, 112, 114 and/or 116
  Variant (2)..(3): Xaa in position 2 to 3 is any amino acid
  Variant (4)..(7): Xaa in position 4 to 7 is any or no amino acid
  Variant (9)..(9): Xaa in position 9 is Phe, Leu or Val
  Variant (10)..(10): Xaa in position 10 is any amino acid
  Variant (13)..(13): Xaa in position 13 is Ala, Leu or Val
  Variant (14)..(14): Xaa in position 14 is any amino acid
  Variant (16)..(16): Xaa in position 16 is Thr or Val
  Variant (17)..(17): Xaa in position 17 is Ala, Ile or Leu
  Variant (18)..(18): Xaa in position 18 is Phe, Ile or Leu
KXXXXXXMXXYNXXQXXXN

SEQ ID NO: 122 - DNA, 879 bp, Ostreococcus tauri
  CDS (1)..(879)
atgtctggattgagggctcctaacttcttgcataggttctggaccaagtgggattacgctatctctaaggtggtgttcacttgcgctgattctttccagtgggatatcggacctgtttcttcttctaccgctcatttgcctgctattgagtctcctactcctttggtgacctctttgctcttctacttggtgactgtgttcttgtggtacggaagattgaccagatcctccgataagaagatcagagagcctacctggttgaggagattcatcatctgccacaacgctttcttgattgtgctctccttgtacatgtgtttgggatgcgttgctcaagcttaccaaaacggatacaccttgtggggaaacgagttcaaggctactgagacccaattggctctctacatctacatcttctacgtgtccaagatctacgagttcgtggatacctacatcatgctcctcaagaacaacctcaggcaagtgtctttcttgcacatctaccaccactctaccatctctttcatctggtggatcatcgctagaagagcacctggaggagatgcttatttctccgctgctctcaactcttgggttcatgtgtgcatgtacacttactacctcctctctaccttgattggaaaggaagatcctaagaggtctaactacctctggtggggaaggcatttgacccaaatgcaaatgctccagttcttcttcaacgtgctccaagctctttattgcgcttccttctccacttaccctaagttcctctccaagatcttgctcgtgtacatgatgtctttgctcggacttttcggacacttctactactctaagcacatcgctgctgctaagttgcaaaagaagcagcagtga

SEQ ID NO: 123 - protein, 292 aa, Ostreococcus tauri
MSGLRAPNFLHRFWTKWDYAISKVVFTCADSFQWDIGPVSSSTAHLPAIESPTPLVTSLLFYLVTVFLWYGRLTRSSDKKIREPTWLRRFIICHNAFLIVLSLYMCLGCVAQAYQNGYTLWGNEFKATETQLALYIYIFYVSKIYEFVDTYIMLLKNNLRQVSFLHIYHHSTISFIWWIIARRAPGGDAYFSAALNSWVHVCMYTYYLLSTLIGKEDPKRSNYLWWGRHLTQMQMLQFFFNVLQALYCASFSTYPKFLSKILLVYMMSLLGLFGHFYYSKHIAAAKLQKKQQ

SEQ ID NO: 124 - DNA, 1047 bp, Marchantia polymorpha
  CDS (1)..(1047)
atggcgacgaagagcgggagcggattgctcgagtggatagcagtagcggcgaagatgaagcaagctcggagcagccccgagggtgagatcgtgggtgggaataggatgggctctggaaacggagctgagtggaccacgagtctgattcatgcatttttgaatgccacgaatgggaagagcggcggtgcttcgaaagtgaggcctctcgaggagagaatcggggaggcggtgttcagagttcttgaagatgtcgtgggcgtggatattaggaagccgaatcctgtcacgaaggaccttccgatggtcgagagtcccgtgcccgtgttggcctgcatttctctgtacttgctcgtggtgtggctttggtcttctcacattaaggcgtctggccaaaagcccaggaaggaggacccgctcgccctgcgttgccttgtgattgcccacaatctgttcctgtgttgcttgagcttgttcatgtgcgtcggtctcattgccgcagctcgacattacgggtatagtgtatgggggaactactacagagaaagagaacccgcaatgaatttgctcatttacgtgttctacatgtcgaagctgtacgaatttatggacacggccattatgttattcagaagaaatctgcgacaagtcacgtacttgcatgtatatcaccacgcaagcatcgcaatgatttggtggataatttgctatcggtttccaggagctgattcgtatttctccgcagcattcaattcctgtatccatgtagcgatgtacctgtattatctactcgcggcaaccgtcgccagagacgaaaagcggagacgcaaatatctcttctggggaaagtatctgaccatcatacaaatgcttcagtttttgtccttcattgggcaggcgatttatgcaatgtggaagtttgaatactatcccaagggctttggcaggatgttgttcttttactctgtatcattgttggcatttttcggcaacttctttgtcaaaaagtattcgaacgcttcacagcctaagacagttaaagtggagtga

SEQ ID NO: 125 - protein, 348 aa, Marchantia polymorpha
MATKSGSGLLEWIAVAAKMKQARSSPEGEIVGGNRMGSGNGAEWTTSLIHAFLNATNGKSGGASKVRPLEERIGEAVFRVLEDVVGVDIRKPNPVTKDLPMVESPVPVLACISLYLLVVWLWSSHIKASGQKPRKEDPLALRCLVIAHNLFLCCLSLFMCVGLIAAARHYGYSVWGNYYREREPAMNLLIYVFYMSKLYEFMDTAIMLFRRNLRQVTYLHVYHHASIAMIWWIICYRFPGADSYFSAAFNSCIHVAMYLYYLLAATVARDEKRRRKYLFWGKYLTIIQMLQFLSFIGQAIYAMWKFEYYPKGFGRMLFFYSVSLLAFFGNFFVKKYSNASQPKTVKVE

SEQ ID NO: 126 - DNA, 831 bp, Thraustochytrium sp
  CDS (1)..(831)
atggatgtcgtcgagcagcaatggcgccgcttcgtggacgccgtggacaacggaatcgtggagttcatggagcatgaggagcccaacaagctgaacgagggcaagctctccacctcgaccgaggagatgatggcgcttatcgtcggctacctggcgttcgtggtcctcgggtccgccttcatgaaggcctttgtcgataagcctttcgagctcaagttcctcaagctcgtgcacaacatcttcctcaccggtctgtccatgtacatggccaccgagtgcgcgcgccaggcatacctcggcggctacaagctctttggcaacccgatggagaagggcaccgagtcgcacgccccgggcatggccaacatcatctacatcttctacgtgagcaagttcctcgaattcctcgacaccgtcttcatgatcctcggcaagaagtggaagcagctcagctttctccacgtctaccaccacgcgagcatcagcttcatctggggcatcatcgcccgcttcgcgcccggtggcgacgcctacttctctaccatcctcaacagcagcgtgcatgtcgtgctctacggctactacgcctcgaccaccctcggctacaccttcatgcgcccgctgcgcccgtacattaccaccattcagctcacgcagttcatggccatggtcgtccagtccgtctatgactactacaacccctgcgactacccgcagcccctcgtcaagctgctcttctggtacatgctcaccatgctcggcctcttcggcaacttcttcgtgcagcagtacctcaagcccaaggcgcccaagaagcagaagaccatctaa

SEQ ID NO: 127 - protein, 276 aa, Thraustochytrium sp
MDVVEQQWRRFVDAVDNGIVEFMEHEEPNKLNEGKLSTSTEEMMALIVGYLAFVVLGSAFMKAFVDKPFELKFLKLVHNIFLTGLSMYMATECARQAYLGGYKLFGNPMEKGTESHAPGMANIIYIFYVSKFLEFLDTVFMILGKKWKQLSFLHVYHHASISFIWGIIARFAPGGDAYFSTILNSSVHVVLYGYYASTTLGYTFMRPLRPYITTIQLTQFMAMVVQSVYDYYNPCDYPQPLVKLLFWYMLTMLGLFGNFFVQQYLKPKAPKKQKTI

SEQ ID NO: 128 - DNA, 1146 bp, Leishmania major
  CDS (1)..(1146)
atggtctctctggagcaggccgaacagatcgcggccgcgatcgaggtacctgactgggtcttgacaaagtctgcggcgctggtgtacagctgcttcggctccgccgccaatgcttttgaaagcagtatcaagatcaacttcccggcgcagcatgcgttcgtggaggcgtggatgcgcgcgcgctcccacccttttgcggagcgcctgccgtacctgaatccgtggcacgttatcgcctcgatactggcctacctctccttgattgtcaccttgcgcctgttgcatcgtgtactcggtaagttctcgtgccgcactctcggattggtgcacaacctcggtctccatcttctctcgttgtacatgagccttggtctcatgatcagcgcgcgcgccgcggggtactcgctctggaacaacgcggtcggcacctccccggctgagtggcgcattgcgaagctgatctggctcttctatgtctcgaaggtggtggaatgggtggacacggtaattatgttattaaagcagaactaccaccaggtcaccttcctgcacgtgtatcaccacacgacggtttttgtgctgtggtggctggcgttgctggtcgctcctggcggcgagtcgtactacagcgccatggtgaactctggcgtccacgttttcatgtacgggtactactttctcacgctgctcttcccatccggcatcgtgcgcgacgtcttgagcaagttcaagtttgccattacgaagggccagatgtggcagttcgtcttcaactgcctacagtccgcgtacgacctcgtgtgggtgccgcgggaagagctcaagtacagcgcggagctgctgcagatcctcttctggtacatgatctccctcttggcgctctttggcaacttcttggtgaagaacaagaagttctcgcaccgccgctgcgttgatgccgcgactgcttcgggcgcgaaggaggacacggcggcgaggtcccacggcgaccgcacccacagaacccgtgtgaaggctggcatgaccaacatgcaactggagaggctgaagaatgagaagtccacggagatgaagctgctgatgcgcaagaacggcaacggcaacggacaaaaagcgtcgctccaggccatggcaggcagtcgatga

SEQ ID NO: 129 - protein, 381 aa, Leishmania major
MVSLEQAEQIAAAIEVPDWVLTKSAALVYSCFGSAANAFESSIKINFPAQHAFVEAWMRARSHPFAERLPYLNPWHVIASILAYLSLIVTLRLLHRVLGKFSCRTLGLVHNLGLHLLSLYMSLGLMISARAAGYSLWNNAVGTSPAEWRIAKLIWLFYVSKVVEWVDTVIMLLKQNYHQVTFLHVYHHTTVFVLWWLALLVAPGGESYYSAMVNSGVHVFMYGYYFLTLLFPSGIVRDVLSKFKFAITKGQMWQFVFNCLQSAYDLVWVPREELKYSAELLQILFWYMISLLALFGNFLVKNKKFSHRRCVDAATASGAKEDTAARSHGDRTHRTRVKAGMTNMQLERLKNEKSTEMKLLMRKNGNGNGQKASLQAMAGSR

SEQ ID NO: 130 - DNA, 879 bp, Ostreococcus tauri
  CDS (1)..(879)
atgagtggcttacgtgcacccaactttttacacagattctggacaaagtgggactacgcgatttccaaagtcgtcttcacgtgtgccgacagttttcagtgggacatcgggccagtgagttcgagtacggcgcatttacccgccattgaatcccctaccccactggtgactagcctcttgttctacttagtcacagttttcttgtggtatggtcgtttaaccaggagttcagacaagaaaattagagagcctacgtggttaagaagattcataatatgtcataatgcgttcttgatagtcctcagtctttacatgtgccttggttgtgtggcccaagcgtatcagaatggatatactttatggggtaatgaattcaaggccacggaaactcagcttgctctctacatttacattttttacgtaagtaaaatatacgagtttgtagatacttacattatgcttctcaagaataacttgcggcaagtaagtttcctacacatttatcaccacagcacgatttcctttatttggtggatcattgctcggagggctccgggtggtgatgcttacttcagcgcggccttgaactcatgggtacacgtgtgcatgtacacctattatctattatcaacccttattggaaaagaagatcctaagcgttccaactacctttggtggggtcgccacctaacgcaaatgcagatgcttcagtttttcttcaacgtacttcaagcgttgtactgcgcttcgttctctacgtatcccaagtttttgtccaaaattctgctcgtctatatgatgagccttctcggcttgtttgggcatttctactattccaagcacatagcagcagctaagctccagaaaaaacagcagtga

SEQ ID NO: 131 - protein, 292 aa, Ostreococcus tauri; identical to SEQ ID NO: 123

SEQ ID NO: 132 - DNA, 873 bp, Marchantia polymorpha
  CDS (1)..(873)
atggaggcgtacgagatggtggatagttttgtgtcgaagacggttttcgaaacgctgcagagactgaggggcggagtcgtgttgacggaatctgcgatcaccaaaggtttgccatgcgtcgatagcccgacgccgatcgttcttgggttgtcgtcctacttgacattcgtgtttctcgggctcattgtcatcaagagcctggatcttaagccccgctccaaggagcccgccattttgaacctgtttgtgatcttccacaacttcgtctgcttcgcactcagtctgtacatgtgcgtgggaattgtccgtcaagctatcctcaacaggtactctctgtggggcaatgcgtacaatcccaaagaagttcaaatgggccacctgctctacattttctacatgtcaaagtacatcgagtttatggacacggtcattatgattttgaagcgcaacacgcgccagatcactgtgttgcatgtgtaccaccacgcatccatctccttcatctggtggatcatcgcctaccatgctcctggcggtgaagcttatttctctgccgcattgaactccggagtacatgtgctcatgtacctctactaccttttggcagcaactctgggaaagaacgagaaagctcgccgcaagtacctatggtggggaaaatacttgacacagctgcagatgttccagtttgtccttaacatgattcaggcttactacgatattaagaacaactcgccttacccacaatttttgatccagattttgttctactacatgatctcgcttttagcgctatttggaaacttttacgttcacaaatacgtatcagcgcccgcaaaacctgcgaagatcaagagcaaaaaggcagaataa

SEQ ID NO: 133 - protein, 290 aa, Marchantia polymorpha
MEAYEMVDSFVSKTVFETLQRLRGGVVLTESAITKGLPCVDSPTPIVLGLSSYLTFVFLGLIVIKSLDLKPRSKEPAILNLFVIFHNFVCFALSLYMCVGIVRQAILNRYSLWGNAYNPKEVQMGHLLYIFYMSKYIEFMDTVIMILKRNTRQITVLHVYHHASISFIWWIIAYHAPGGEAYFSAALNSGVHVLMYLYYLLAATLGKNEKARRKYLWWGKYLTQLQMFQFVLNMIQAYYDIKNNSPYPQFLIQILFYYMISLLALFGNFYVHKYVSAPAKPAKIKSKKAE

SEQ ID NO: 134 - DNA, 873 bp, Physcomitrella patens
  CDS (1)..(873)
atggaggtcgtggagagattctacggtgagttggatgggaaggtctcgcagggcgtgaatgcattgctgggtagttttggggtggagttgacggatacgcccactaccaaaggcttgcccctcgttgacagtcccacacccatcgtcctcggtgtttctgtatacttgactattgtcattggagggcttttgtggataaaggccagggatctgaaaccgcgcgcctcggagccatttttgctccaagctttggtgcttgtgcacaacctgttctgttttgcgctcagtctgtatatgtgcgtgggcatcgcttatcaggctattacctggcggtactctctctggggcaatgcatacaatcctaaacataaagagatggcgattctggtatacttgttctacatgtctaagtacgtggaattcatggataccgttatcatgatactgaagcgcagcaccaggcaaataagcttcctccacgtttatcatcattcttcaatttccctcatttggtgggctattgctcatcacgctcctggcggtgaagcatattggtctgcggctctgaactcaggagtgcatgttctcatgtatgcgtattacttcttggctgcctgccttcgaagtagcccaaagttaaaaaataagtaccttttttggggcaggtacttgacacaattccaaatgttccagtttatgctgaacttagtgcaggcttactacgacatgaaaacgaatgcgccatatccacaatggctgatcaagattttgttctactacatgatctcgttgctgtttcttttcggcaatttttacgtacaaaaatacatcaaaccctctgacggaaagcaaaagggagctaaaactgagtga

SEQ ID NO: 135 - protein, 290 aa, Physcomitrella patens
MEVVERFYGELDGKVSQGVNALLGSFGVELTDTPTTKGLPLVDSPTPIVLGVSVYLTIVIGGLLWIKARDLKPRASEPFLLQALVLVHNLFCFALSLYMCVGIAYQAITWRYSLWGNAYNPKHKEMAILVYLFYMSKYVEFMDTVIMILKRSTRQISFLHVYHHSSISLIWWAIAHHAPGGEAYWSAALNSGVHVLMYAYYFLAACLRSSPKLKNKYLFWGRYLTQFQMFQFMLNLVQAYYDMKTNAPYPQWLIKILFYYMISLLFLFGNFYVQKYIKPSDGKQKGAKTE

SEQ ID NO: 136 - DNA, 957 bp, Mortierella alpina
  CDS (1)..(957)
atggagtcgattgcgccattcctcccatcaaagatgccgcaagatctgtttatggaccttgccaccgctatcggtgtccgggccgcgccctatgtcgatcctctcgaggccgcgctggtggcccaggccgagaagtacatccccacgattgtccatcacacgcgtgggttcctggtcgcggtggagtcgcctttggcccgtgagctgccgttgatgaacccgttccacgtgctgttgatcgtgctcgcttatttggtcacggtctttgtgggcatgcagatcatgaagaactttgagcggttcgaggtcaagacgttttcgctcctgcacaacttttgtctggtctcgatcagcgcctacatgtgcggtgggatcctgtacgaggcttatcaggccaactatggactgtttgagaacgctgctgatcataccttcaagggtcttcctatggccaagatgatctggctcttctacttctccaagatcatggagtttgtcgacaccatgatcatggtcctcaagaagaacaaccgccagatctccttcttgcacgtttaccaccacagctccatcttcaccatctggtggttggtcacctttgttgcacccaacggtgaagcctacttctctgctgcgttgaactcgttcatccatgtgatcatgtacggctactacttcttgtcggccttgggcttcaagcaggtgtcgttcatcaagttctacatcacgcgctcgcagatgacacagttctgcatgatgtcggtccagtcttcctgggacatgtacgccatgaaggtccttggccgccccggataccccttcttcatcacggctctgctttggttctacatgtggaccatgctcggtctcttctacaacttttacagaaagaacgccaagttggccaagcaggccaaggccgacgctgccaaggagaaggcaaggaagttgcagtaa

SEQ ID NO: 137 - protein, 318 aa, Mortierella alpina
MESIAPFLPSKMPQDLFMDLATAIGVRAAPYVDPLEAALVAQAEKYIPTIVHHTRGFLVAVESPLARELPLMNPFHVLLIVLAYLVTVFVGMQIMKNFERFEVKTFSLLHNFCLVSISAYMCGGILYEAYQANYGLFENAADHTFKGLPMAKMIWLFYFSKIMEFVDTMIMVLKKNNRQISFLHVYHHSSIFTIWWLVTFVAPNGEAYFSAALNSFIHVIMYGYYFLSALGFKQVSFIKFYITRSQMTQFCMMSVQSSWDMYAMKVLGRPGYPFFITALLWFYMWTMLGLFYNFYRKNAKLAKQAKADAAKEKARKLQ

SEQ ID NO: 138 - protein, 242 aa, Artificial sequence
  Amino acid sequence obtainable by alignment of SEQ ID No. 125, 127, 129, 131, 133, 135 and/or 137
  Variant (3)..(5): Xaa in position 3 to 5 is any amino acid
  Variant (6)..(6): Xaa in position 6 is any or no amino acid
  Variant (8)..(16): Xaa in position 8 to 16 is any amino acid
  Variant (19)..(20): Xaa in position 19 to 20 is any amino acid
  Variant (22)..(42): Xaa in position 22 to 42 is any amino acid
  Variant (43)..(49): Xaa in position 43 to 49 is any or no amino acid
  Variant (52)..(56): Xaa in position 52 to 56 is any amino acid
  Variant (59)..(59): Xaa in position 59 is any amino acid
  Variant (62)..(63): Xaa in position 62 to 63 is any amino acid
  Variant (65)..(68): Xaa in position 65 to 68 is any amino acid
  Variant (70)..(73): Xaa in position 70 to 73 is any amino acid
  Variant (75)..(75): Xaa in position 75 is any amino acid
  Variant (77)..(78): Xaa in position 77 to 78 is any amino acid
  Variant (80)..(94): Xaa in position 80 to 94 is any amino acid
  Variant (95)..(98): Xaa in position 95 to 98 is any or no amino acid
  Variant (101)..(101): Xaa in position 101 is any amino acid
  Variant (104)..(105): Xaa in position 104 to 105 is any amino acid
  Variant (108)..(108): Xaa in position 108 is any amino acid
  Variant (111)..(111): Xaa in position 111 is any amino acid
  Variant (114)..(114): Xaa in position 114 is any amino acid
  Variant (116)..(120): Xaa in position 116 to 120 is any amino acid
  Variant (122)..(124): Xaa in position 122 to 124 is any amino acid
  Variant (127)..(127): Xaa in position 127 is any amino acid
  Variant (131)..(132): Xaa in position 131 to 132 is any amino acid
  Variant (134)..(135): Xaa in position 134 to 135 is any amino acid
  Variant (139)..(143): Xaa in position 139 to 143 is any amino acid
  Variant (148)..(149): Xaa in position 148 to 149 is any amino acid
  Variant (151)..(151): Xaa in position 151 is any amino acid
  Variant (154)..(155): Xaa in position 154 to 155 is any amino acid
  Variant (158)..(159): Xaa in position 158 to 159 is any amino acid
  Variant (162)..(162): Xaa in position 162 is any amino acid
  Variant (165)..(165): Xaa in position 165 is any amino acid
  Variant (168)..(168): Xaa in position 168 is any amino acid
  Variant (170)..(184): Xaa in position 170 to 184 is any amino acid
  Variant (185)..(190): Xaa in position 185 to 190 is any or no amino acid
  Variant (192)..(193): Xaa in position 192 to 193 is any amino acid
  Variant (196)..(196): Xaa in position 196 is any amino acid
  Variant (199)..(203): Xaa in position 199 to 203 is any amino acid
  Variant (205)..(206): Xaa in position 205 to 206 is any amino acid
  Variant (208)..(213): Xaa in position 208 to 213 is any amino acid
  Variant (214)..(219): Xaa in position 214 to 219 is any or no amino acid
  Variant (222)..(227): Xaa in position 222 to 227 is any amino acid
  Variant (229)..(230): Xaa in position 229 to 230 is any amino acid
  Variant (233)..(235): Xaa in position 233 to 235 is any amino acid
  Variant (237)..(237): Xaa in position 237 is any amino acid
  Variant (241)..(241): Xaa in position 241 is any amino acid
LPXXXXPXXXXXXXXXYLXXVXXXXXXXXXXXXXXXXXXXXXXXXXXXXHNXXXXXLSXYMXXGXXXXAXXXXYXLXXNXXXXXXXXXXXXXXXXXXXFYXSKXXEFXDTXIMXLXXXXXQXXXLHXYHHXXIXXIWWXXXXXAPGGXXYXSAXXNSXXHVXMYXYYXLXXXXXXXXXXXXXXXXXXXXXTXXQMXQFXXXXXQXXYXXXXXXXXXXXXYPXXXXXXLXXYMXXXLXLFGXF

SEQ ID NO: 139 - protein, 60 aa, Artificial sequence
  Amino acid sequence obtainable by alignment of SEQ ID No. 125, 127, 129, 131, 133, 135 and/or 137
  Variant (2)..(2): Xaa in position 2 is Phe or Trp
  Variant (3)..(3): Xaa in position 3 is Leu, Met or Val
  Variant (6)..(6): Xaa in position 6 is any amino acid
  Variant (7)..(7): Xaa in position 7 is Phe or Ile
  Variant (9)..(9): Xaa in position 9 is any or no amino acid
  Variant (11)..(11): Xaa in position 11 is any or no amino acid
  Variant (13)..(15): Xaa in position 13 to 15 is any amino acid
  Variant (16)..(16): Xaa in position 16 is any or no amino acid
  Variant (18)..(18): Xaa in position 18 is Ile, Leu or Val
  Variant (19)..(19): Xaa in position 19 is Ser or Thr
  Variant (20)..(20): Xaa in position 20 is Phe or Val
  Variant (23)..(23): Xaa in position 23 is Ile or Val
  Variant (27)..(27): Xaa in position 27 is Ala, Ser or Thr
  Variant (28)..(28): Xaa in position 28 is Ser or Thr
  Variant (29)..(29): Xaa in position 29 is Ile or Val
  Variant (30)..(31): Xaa in position 30 to 31 is any amino acid
  Variant (32)..(32): Xaa in position 32 is Ile or Leu
  Variant (34)..(34): Xaa in position 34 is any amino acid
  Variant (35)..(35): Xaa in position 35 is Ala, Ile or Leu
  Variant (36)..(36): Xaa in position 36 is Ala, Ile or Val
  Variant (37)..(39): Xaa in position 37 to 39 is any amino acid
  Variant (42)..(42): Xaa in position 42 is Gly or Asn
  Variant (44)..(44): Xaa in position 44 is Asp or Glu
  Variant (45)..(45): Xaa in position 45 is Ala or Ser
  Variant (47)..(47): Xaa in position 47 is Phe, Trp or Tyr
  Variant (49)..(49): Xaa in position 49 is Ala or Thr
  Variant (50)..(50): Xaa in position 50 is any amino acid
  Variant (51)..(51): Xaa in position 51 is Leu or Val
  Variant (54)..(54): Xaa in position 54 is any amino acid
  Variant (55)..(55): Xaa in position 55 is Ile or Val
  Variant (58)..(58): Xaa in position 58 is any amino acid
  Variant (59)..(59): Xaa in position 59 is Leu or Met
EXXDTXXMXLXKXXXXQXXXLHXYHHXXXXXXWXXXXXXAPXGXXYXSXXXNSXXHVXXY

SEQ ID NO: 140 - protein, 22 aa, Artificial sequence
  Amino acid sequence obtainable by alignment of SEQ ID No. 125, 127, 129, 131, 133, 135 and/or 137
  Variant (2)..(2): Xaa in position 2 is Ala or Leu
  Variant (3)..(3): Xaa in position 3 is Phe or Tyr
  Variant (5)..(5): Xaa in position 5 is Cys or Ser
  Variant (6)..(6): Xaa in position 6 is Gly, Leu or Val
  Variant (8)..(9): Xaa in position 8 to 9 is any amino acid
  Variant (10)..(11): Xaa in position 10 to 11 is any or no amino acid
  Variant (13)..(14): Xaa in position 13 to 14 is any amino acid
  Variant (15)..(16): Xaa in position 15 to 16 is any or no amino acid
  Variant (18)..(18): Xaa in position 18 is Gly, Ser or Thr
  Variant (19)..(19): Xaa in position 19 is Leu or Val
  Variant (20)..(20): Xaa in position 20 is Phe or Trp
  Variant (21)..(21): Xaa in position 21 is Glu, Gly or Asn
SXXMXXGXXXXAXXXXYXXXXN

SEQ ID NO: 141 - protein, 18 aa, Artificial sequence
  Amino acid sequence obtainable by alignment of SEQ ID No. 125, 127, 129, 131, 133, 135 and/or 137
  Variant (2)..(3): Xaa in position 2 to 3 is any amino acid
  Variant (6)..(6): Xaa in position 6 is any amino acid
  Variant (9)..(12): Xaa in position 9 to 12 is any amino acid
  Variant (13)..(13): Xaa in position 13 is Gly, Ile, Leu or Val
  Variant (15)..(15): Xaa in position 15 is Ala or Ser
  Variant (16)..(16): Xaa in position 16 is any amino acid
  Variant (17)..(17): Xaa in position 17 is Trp or Tyr
  Variant (18)..(18): Xaa in position 18 is Ala, Cys or Asp
TXXQMXQFXXXXXQXXXX

SEQ ID NO: 142 - protein, 25 aa, Artificial sequence
  Amino acid sequence obtainable by alignment of SEQ ID No. 125, 127, 129, 131, 133, 135 and/or 137
  Variant (2)..(2): Xaa in position 2 is any or no amino acid
  Variant (4)..(5): Xaa in position 4 to 5 is any amino acid
  Variant (6)..(6): Xaa in position 6 is Phe, Ile or Leu
  Variant (7)..(8): Xaa in position 7 to 8 is any amino acid
  Variant (9)..(9): Xaa in position 9 is Ile, Leu or Met
  Variant (11)..(12): Xaa in position 11 to 12 is any amino acid
  Variant (14)..(15): Xaa in position 14 to 15 is any amino acid
  Variant (16)..(16): Xaa in position 16 is Ser or Thr
  Variant (17)..(17): Xaa in position 17 is Leu or Met
  Variant (19)..(19): Xaa in position 19 is any amino acid
  Variant (20)..(20): Xaa in position 20 is Phe or Leu
  Variant (22)..(23): Xaa in position 22 to 23 is any amino acid
  Variant (25)..(25): Xaa in position 25 is Phe or Tyr
YXPXXXXXXLXXYXXXXLXXFXXFX

SEQ ID NO: 143 - DNA, 879 bp, Ostreococcus tauri; identical to SEQ ID NO: 130
  CDS (1)..(879)

SEQ ID NO: 144 - protein, 292 aa, Ostreococcus tauri; identical to SEQ ID NO: 123

SEQ ID NO: 145 - DNA, 831 bp, Thraustochytrium sp; identical to SEQ ID NO: 126
  CDS (1)..(831)

SEQ ID NO: 146 - protein, 276 aa, Thraustochytrium sp; identical to SEQ ID NO: 127

SEQ ID NO: 147 - DNA, 1146 bp, Leishmania major; identical to SEQ ID NO: 128
  CDS (1)..(1146)

SEQ ID NO: 148 - protein, 381 aa, Leishmania major; identical to SEQ ID NO: 129

SEQ ID NO: 149 - DNA, 879 bp, Ostreococcus tauri; identical to SEQ ID NO: 130
  CDS (1)..(879)

SEQ ID NO: 150 - protein, 292 aa, Ostreococcus tauri; identical to SEQ ID NO: 123

SEQ ID NO: 151 - DNA, 873 bp, Physcomitrella patens; identical to SEQ ID NO: 134
  CDS (1)..(873)

SEQ ID NO: 152 - protein, 290 aa, Physcomitrella patens; identical to SEQ ID NO: 135

SEQ ID NO: 153 - DNA, 957 bp, Mortierella alpina; identical to SEQ ID NO: 136
  CDS (1)..(957)

SEQ ID NO: 154 - protein, 318 aa, Mortierella alpina; identical to SEQ ID NO: 137

SEQ ID NO: 155 - protein, 236 aa, Artificial sequence
  Amino acid sequence obtainable by alignment of SEQ ID No. 144, 146, 148, 150, 152 and/or 154
  Variant (2)..(8): Xaa in position 2 to 8 is any amino acid
  Variant (10)..(10): Xaa in position 10 is any amino acid
  Variant (13)..(14): Xaa in position 13 to 14 is any amino acid
  Variant (16)..(36): Xaa in position 16 to 36 is any amino acid
  Variant (37)..(43): Xaa in position 37 to 43 is any or no amino acid
  Variant (46)..(47): Xaa in position 46 to 47 is any amino acid
  Variant (49)..(50): Xaa in position 49 to 50 is any amino acid
  Variant (53)..(53): Xaa in position 53 is any amino acid
  Variant (56)..(57): Xaa in position 56 to 57 is any amino acid
  Variant (59)..(62): Xaa in position 59 to 62 is any amino acid
  Variant (64)..(67): Xaa in position 64 to 67 is any amino acid
  Variant (69)..(69): Xaa in position 69 is any amino acid
  Variant (71)..(72): Xaa in position 71 to 72 is any amino acid
  Variant (74)..(82): Xaa in position 74 to 82 is any amino acid
  Variant (83)..(86): Xaa in position 83 to 86 is any or no amino acid
  Variant (88)..(89): Xaa in position 88 to 89 is any amino acid
  Variant (91)..(92): Xaa in position 91 to 92 is any amino acid
  Variant (95)..(95): Xaa in position 95 is any amino acid
  Variant (98)..(99): Xaa in position 98 to 99 is any amino acid
  Variant (102)..(102): Xaa in position 102 is any amino acid
  Variant (105)..(105): Xaa in position 105 is any amino acid
  Variant (108)..(108): Xaa in position 108 is any amino acid
  Variant (111)..(114): Xaa in position 111 to 114 is any amino acid
  Variant (116)..(116): Xaa in position 116 is any amino acid
  Variant (121)..(121): Xaa in position 121 is any amino acid
  Variant (125)..(126): Xaa in position 125 to 126 is any amino acid
  Variant (128)..(129): Xaa in position 128 to 129 is any amino acid
  Variant (133)..(137): Xaa in position 133 to 137 is any amino acid
  Variant (142)..(142): Xaa in position 142 is any amino acid
  Variant (145)..(145): Xaa in position 145 is any amino acid
  Variant (148)..(148): Xaa in position 148 is any amino acid
  Variant (152)..(152): Xaa in position 152 is any amino acid
  Variant (156)..(156): Xaa in position 156 is any amino acid
  Variant (159)..(159): Xaa in position 159 is any amino acid
  Variant (162)..(162): Xaa in position 162 is any amino acid
  Variant (164)..(165): Xaa in position 164 to 165 is any amino acid
  Variant (167)..(178): Xaa in position 167 to 178 is any amino acid
  Variant (179)..(184): Xaa in position 179 to 184 is any or no amino acid
  Variant (186)..(187): Xaa in position 186 to 187 is any amino acid
  Variant (190)..(190): Xaa in position 190 is any amino acid
  Variant (193)..(197): Xaa in position 193 to 197 is any amino acid
  Variant (199)..(200): Xaa in position 199 to 200 is any amino acid
  Variant (202)..(207): Xaa in position 202 to 207 is any amino acid
  Variant (208)..(213): Xaa in position 208 to 213 is any or no amino acid
  Variant (216)..(217): Xaa in position 216 to 217 is any amino acid
  Variant (219)..(221): Xaa in position 219 to 221 is any amino acid
  Variant (223)..(224): Xaa in position 223 to 224 is any amino acid
  Variant (227)..(229): Xaa in position 227 to 229 is any amino acid
  Variant (231)..(231): Xaa in position 231 is any amino acid
  Variant (235)..(235): Xaa in position 235 is any amino acid
PXXXXXXXLXYLXXVXXXXXXXXXXXXXXXXXXXXXXXXXXXXHNXXLXXLSXYMXXGXXXXAXXXXYXLXXNXXXXXXXXXXXXXAXXIXXFYXSKXXEFXDTXIMXLKXXXXQXSFLHXYHHXXIXXIWWXXXXXAPGGXAYXSAXLNSXVHVXMYXYYXLXXLXXXXXXXXXXXXXXXXXXTXXQMXQFXXXXXQXXYXXXXXXXXXXXXYPXXLXXXLXXYMXXXLXLFGXF

SEQ ID NO: 156 - protein, 59 aa, Artificial sequence
  Amino acid sequence obtainable by alignment of SEQ ID No. 144, 146, 148, 150, 152 and/or 154
  Variant (2)..(2): Xaa in position 2 is any amino acid
  Variant (5)..(5): Xaa in position 5 is any amino acid
  Variant (6)..(6): Xaa in position 6 is Phe or Ile
  Variant (8)..(8): Xaa in position 8 is Ile, Leu or Val
  Variant (10)..(13): Xaa in position 10 to 13 is any amino acid
  Variant (14)..(14): Xaa in position 14 is Lys or Arg
  Variant (16)..(16): Xaa in position 16 is Ile, Leu or Val
  Variant (21)..(21): Xaa in position 21 is Ile or Val
  Variant (25)..(25): Xaa in position 25 is Ala or Ser
  Variant (26)..(26): Xaa in position 26 is Ser or Thr
  Variant (28)..(29): Xaa in position 28 to 29 is any amino acid
  Variant (32)..(32): Xaa in position 32 is any amino acid
  Variant (33)..(33): Xaa in position 33 is Ala, Ile or Leu
  Variant (34)..(34): Xaa in position 34 is Ile or Val
  Variant (35)..(35): Xaa in position 35 is Ala or Thr
  Variant (36)..(37): Xaa in position 36 to 37 is any amino acid
  Variant (40)..(40): Xaa in position 40 is Gly or Asn
  Variant (42)..(42): Xaa in position 42 is Asp or Glu
  Variant (45)..(45): Xaa in position 45 is Phe or Trp
  Variant (47)..(47): Xaa in position 47 is Ala or Thr
  Variant (48)..(48): Xaa in position 48 is Ala or Ile
  Variant (52)..(52): Xaa in position 52 is any amino acid
  Variant (53)..(53): Xaa in position 53 is Ile or Val
  Variant (56)..(56): Xaa in position 56 is any amino acid
  Variant (57)..(57): Xaa in position 57 is Leu or Met
  Variant (59)..(59): Xaa in position 59 is Ala, Gly or Thr
FXDTXXMXLXXXXXQXSFLHXYHHXXIXXIWXXXXXXAPXGXAYXSXXLNSXXHVXXYX

SEQ ID NO: 157 - protein, 22 aa, Artificial sequence
  Amino acid sequence obtainable by alignment of SEQ ID No. 144, 146, 148, 150, 152 and/or 154
  Variant (2)..(2): Xaa in position 2 is Leu or Met
  Variant (5)..(5): Xaa in position 5 is Ala, Cys or Ser
  Variant (6)..(6): Xaa in position 6 is any amino acid
  Variant (7)..(7): Xaa in position 7 is Glu or Gly
  Variant (8)..(10): Xaa in position 8 to 10 is any amino acid
  Variant (11)..(11): Xaa in position 11 is Gln or Ser
  Variant (13)..(16): Xaa in position 13 to 16 is any amino acid
  Variant (18)..(18): Xaa in position 18 is any amino acid
  Variant (20)..(20): Xaa in position 20 is Phe or Trp
  Variant (21)..(21): Xaa in position 21 is Gly or Asn
SXYMXXXXXXXAXXXXYXLXXN

SEQ ID NO: 158 - protein, 16 aa, Artificial sequence
  Amino acid sequence obtainable by alignment of SEQ ID No. 144, 146, 148, 150, 152 and/or 154
  Variant (2)..(2): Xaa in position 2 is Leu or Met
  Variant (3)..(3): Xaa in position 3 is any amino acid
  Variant (6)..(8): Xaa in position 6 to 8 is any amino acid
  Variant (9)..(9): Xaa in position 9 is any or no amino acid
  Variant (11)..(11): Xaa in position 11 is any or no amino acid
  Variant (13)..(13): Xaa in position 13 is Ala or Ser
  Variant (14)..(14): Xaa in position 14 is any amino acid
  Variant (15)..(15): Xaa in position 15 is Trp or Tyr
  Variant (16)..(16): Xaa in position 16 is Cys or Asp
QXXQFXXXXVXQXXXX

SEQ ID NO: 159 - protein, 24 aa, Artificial sequence
  Amino acid sequence obtainable by alignment of SEQ ID No. 144, 146, 148, 150, 152 and/or 154
  Variant (3)..(4): Xaa in position 3 to 4 is any amino acid
  Variant (5)..(5): Xaa in position 5 is Ile or Leu
  Variant (6)..(7): Xaa in position 6 to 7 is any amino acid
  Variant (8)..(8): Xaa in position 8 is Ile or Leu
  Variant (10)..(11): Xaa in position 10 to 11 is any amino acid
  Variant (14)..(14): Xaa in position 14 is any amino acid
  Variant (15)..(15): Xaa in position 15 is Ser or Thr
  Variant (16)..(16): Xaa in position 16 is Leu or Met
  Variant (18)..(18): Xaa in position 18 is any amino acid
  Variant (21)..(22): Xaa in position 21 to 22 is any amino acid
  Variant (24)..(24): Xaa in position 24 is Phe or Tyr
YPXXXXXXLXXYMXXXLXLFXXFX

SEQ ID NO: 160 - protein, 8 aa, Artificial sequence
  Amino acid sequence obtainable by alignment of SEQ ID No. 144, 146, 148, 150, 152 and/or 154
  Variant (2)..(2): Xaa in position 2 is Trp or Tyr
  Variant (3)..(3): Xaa in position 3 is Ile or Leu
  Variant (6)..(6): Xaa in position 6 is Phe or Val
IXXFYXSK

SEQ ID NO: 161 - DNA, 755 bp, Cauliflower mosaic virus
cctgcaggtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgataacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagga

SEQ ID NO: 162 - DNA, 211 bp, Cauliflower mosaic virus
agtccgcaaaaatcaccagtctctctctacaaatctatctctctctatttttctccagaataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtga

SEQ ID NO: 163 - DNA, 819 bp, Thalassiosira pseudonana
  CDS (1)..(819)
atggacgcctacaacgctgcaatggataagatcggtgccgccatcatcgattggtctgatcccgatggaaagttccgtgccgatagagaggactggtggctctgcgacttccgtagcgccatcaccatcgccctcatctacatcgccttcgtcatcctcggttccgccgtcatgcaatccctccccgcaatggatccctaccccatcaaattcctctacaacgtctcccaaatcttcctttgtgcctacatgactgtcgaggcgggatttttggcctaccgcaatggatataccgtcatgccttgcaatcatttcaatgtgaatgatcctcccgtggcgaatcttctttggttgttttatatttccaaggtgtgggacttttgggataccattttcattgtgttggggaagaagtggcgtcaattatctttcttgcatgtataccatcacaccaccatctttctattctattggctgaatgccaatgtcttgtacgatggtgacatcttccttaccatcttgctcaatggattcatccacacggtgatgtacacgtattacttcatctgtatgcataccaaagattccaagacgggcaagagtcttcctatatggtggaagtcgagtttgacggcgtttcagttgttgcaattcactatcatgatgagtcaggctacctaccttgtcttccacgggtgtgataaggtgtcgcttcgtatcacgattgtgtactttgtgtcccttttgagtttgttcttcctttttgctcagttctttgtgcaatcatacatggcacccaaaaagaagaagagtgcttag

SEQ ID NO: 164 - protein, 272 aa, Thalassiosira pseudonana
MDAYNAAMDKIGAAIIDWSDPDGKFRADREDWWLCDFRSAITIALIYIAFVILGSAVMQSLPAMDPYPIKFLYNVSQIFLCAYMTVEAGFLAYRNGYTVMPCNHFNVNDPPVANLLWLFYISKVWDFWDTIFIVLGKKWRQLSFLHVYHHTTIFLFYWLNANVLYDGDIFLTILLNGFIHTVMYTYYFICMHTKDSKTGKSLPIWWKSSLTAFQLLQFTIMMSQATYLVFHGCDKVSLRITIVYFVSLLSLFFLFAQFFVQSYMAPKKKKSA

SEQ ID NO: 165 - DNA, 837 bp, Phaeodactylum tricornutum
  CDS (1)..(837)
atgatggtaccttcaagttatgacgagtatatcgtcatggtcaacgaccttggcgactctattctgagctgggccgaccctgatcactatcgtggacataccgagggatgggagttcactgacttttctgctgcttttagcattgccgtcgcgtacctcctgtttgtctttgttggatctctcattatgagtatgggagtccccgcaattgacccttatccgctcaagtttgtctacaatgtttcacagattatgctttgtgcttacatgaccattgaagccagtcttctagcttatcgtaacggctacacattctggccttgcaacgattgggactttgaaaagccgcctatcgctaagctcctctggctcttttacgtttccaaaatttgggatttttgggacaccatctttattgttctcgggaagaagtggcgtcaactttccttcctgcacgtctaccatcacaccaccatctttctcttctactggttgaatgcacatgtaaactttgatggtgatattttcctcaccatcgtcttgaacggtttcatccacaccgtcatgtacacgtactacttcatttgcatgcacaccaaggtcccagagaccggcaaatccttgcccatttggtggaaatctagtttgacaagcatgcagctggtgcagttcatcacgatgatgacgcaggctatcatgatcttgtacaagggctgtgctgctccccatagccgggtggtgacatcgtacttggtttacattttgtcgctctttattttgttcgcccagttctttgtcagctcatacctcaagccgaagaagaagaagacagcttaa

SEQ ID NO: 166 - protein, 278 aa, Phaeodactylum tricornutum
MMVPSSYDEYIVMVNDLGDSILSWADPDHYRGHTEGWEFTDFSAAFSIAVAYLLFVFVGSLIMSMGVPAIDPYPLKFVYNVSQIMLCAYMTIEASLLAYRNGYTFWPCNDWDFEKPPIAKLLWLFYVSKIWDFWDTIFIVLGKKWRQLSFLHVYHHTTIFLFYWLNAHVNFDGDIFLTIVLNGFIHTVMYTYYFICMHTKVPETGKSLPIWWKSSLTSMQLVQFITMMTQAIMILYKGCAAPHSRVVTSYLVYILSLFILFAQFFVSSYLKPKKKKTA

SEQ ID NO: 167 - protein, 272 aa, Artificial sequence
  Amino acid sequence obtainable by alignment of SEQ ID No. 164 and/or 166
  Variant (2)..(2): Xaa in position 2 is any amino acid
  Variant (4)..(10): Xaa in position 4 to 10 is any amino acid
  Variant (12)..(13): Xaa in position 12 to 13 is any amino acid
  Variant (15)..(16): Xaa in position 15 to 16 is any amino acid
  Variant (18)..(18): Xaa in position 18 is any amino acid
  Variant (22)..(23): Xaa in position 22 to 23 is any amino acid
  Variant (24)..(24): Xaa in position 24 is any or no amino acid
  Variant (26)..(28): Xaa in position 26 to 28 is any amino acid
  Variant (30)..(30): Xaa in position 30 is any amino acid
  Variant (32)..(34): Xaa in position 32 to 34 is any amino acid
  Variant (37)..(38): Xaa in position 37 to 38 is any amino acid
  Variant (40)..(41): Xaa in position 40 to 41 is any amino acid
  Variant (44)..(45): Xaa in position 44 to 45 is any amino acid
  Variant (47)..(48): Xaa in position 47 to 48 is any amino acid
  Variant (51)..(52): Xaa in position 51 to 52 is any amino acid
  Variant (55)..(56): Xaa in position 55 to 56 is any amino acid
  Variant (58)..(60): Xaa in position 58 to 60 is any amino acid
  Variant (61)..(61): Xaa in position 61 is any or no amino acid
  Variant (64)..(64): Xaa in position 64 is any amino acid
  Variant (69)..(69): Xaa in position 69 is any amino acid
  Variant (72)..(72): Xaa in position 72 is any amino acid
  Variant (79)..(79): Xaa in position 79 is any amino acid
  Variant (86)..(86): Xaa in position 86 is any amino acid
  Variant (89)..(90): Xaa in position 89 to 90 is any amino acid
  Variant (99)..(100): Xaa in position 99 to 100 is any amino acid
  Variant (104)..(109): Xaa in position 104 to 109 is any amino acid
  Variant (112)..(112): Xaa in position 112 is any amino acid
  Variant (114)..(114): Xaa in position 114 is any amino acid
  Variant (121)..(121): Xaa in position 121 is any amino acid
  Variant (124)..(124): Xaa in position 124 is any amino acid
  Variant (162)..(162): Xaa in position 162 is any amino acid
  Variant (164)..(165): Xaa in position 164 to 165 is any amino acid
  Variant (174)..(174): Xaa in position 174 is any amino acid
  Variant (195)..(197): Xaa in position 195 to 197 is any amino acid
  Variant (212)..(213): Xaa in position 212 to 213 is any amino acid
  Variant (216)..(216): Xaa in position 216 is any amino acid
  Variant (219)..(220): Xaa in position 219 to 220 is any amino acid
  Variant (223)..(223): Xaa in position 223 is any amino acid
  Variant (226)..(231): Xaa in position 226 to 231 is any amino acid
  Variant (234)..(238): Xaa in position 234 to 238 is any amino acid
  Variant (240)..(243): Xaa in position 240 to 243 is any amino acid
  Variant (245)..(245): Xaa in position 245 is any amino acid
  Variant (247)..(248): Xaa in position 247 to 248 is any amino acid
  Variant (253)..(253): Xaa in position 253 is any amino acid
  Variant (261)..(261): Xaa in position 261 is any amino acid
  Variant (264)..(265): Xaa in position 264 to 265 is any amino acid
  Variant (271)..(271): Xaa in position 271 is any amino acid
DXYXXXXXXXGXXIXXWXDPDXXXRXXXEXWXXXDFXXAXXIAXXYXXFVXXGSXXMXXXXPAXDPYPXKFXYNVSQIXLCAYMTXEAXXLAYRNGYTXXPCNXXXXXXPPXAXLLWLFYXSKXWDFWDTIFIVLGKKWRQLSFLHVYHHTTIFLFYWLNAXVXXDGDIFLTIXLNGFIHTVMYTYYFICMHTKXXXTGKSLPIWWKSSLTXXQLXQFXXMMXQAXXXXXXGCXXXXXRXXXXYXVXXLSLFXLFAQFFVXSYXXPKKKKXA

SEQ ID NO: 168 - protein, 59 aa, Artificial sequence
  Amino acid sequence obtainable by alignment of SEQ ID No. 164 and/or 166
  Variant (27)..(27): Xaa in position 27 is any amino acid
  Variant (29)..(29): Xaa in position 29 is any amino acid
  Variant (30)..(34): Xaa in position 30 to 34 is any or no amino acid
  Variant (39)..(39): Xaa in position 39 is Leu or Val
GKKWRQLSFLHVYHHTTIFLFYWLNAXVXXXXXXFLTIXLNGFIHTVMYTYYFICMHTK

SEQ ID NO: 169 - protein, 60 aa, Artificial sequence
  Amino acid sequence obtainable by alignment of SEQ ID No. 164 and/or 166
  Variant (7)..(7): Xaa in position 7 is Phe or Met
  Variant (14)..(14): Xaa in position 14 is Ile or Val
  Variant (17)..(17): Xaa in position 17 is any amino acid
  Variant (18)..(18): Xaa in position 18 is any or no amino acid
  Variant (20)..(20): Xaa in position 20 is any or no amino acid
  Variant (28)..(28): Xaa in position 28 is Phe or Val
  Variant (29)..(29): Xaa in position 29 is any amino acid
  Variant (33)..(33): Xaa in position 33 is Asp or His
  Variant (34)..(34): Xaa in position 34 is Phe or Trp
  Variant (35)..(35): Xaa in position 35 is Asp or Asn
  Variant (36)..(36): Xaa in position 36 is Phe or Val
  Variant (37)..(37): Xaa in position 37 is Glu or Asn
  Variant (38)..(38): Xaa in position 38 is Asp or Lys
  Variant (41)..(41): Xaa in position 41 is Ile or Val
  Variant (43)..(43): Xaa in position 43 is any amino acid
  Variant (50)..(50): Xaa in position 50 is Ile or Val
  Variant (53)..(53): Xaa in position 53 is Ile or Val
YNVSQIXLCAYMTXEAXXLXAYRNGYTXXPCNXXXXXXPPXAXLLWLFYXSKXWDFWDTI

SEQ ID NO: 170 - protein, 39 aa, Artificial sequence
  Amino acid sequence obtainable by alignment of SEQ ID No. 164 and/or 166
  Variant (11)..(11): Xaa in position 11 is Ala or Ser
  Variant (12)..(12): Xaa in position 12 is Phe or Met
  Variant (15)..(15): Xaa in position 15 is Leu or Val
  Variant (18)..(18): Xaa in position 18 is any or no amino acid
  Variant (20)..(20): Xaa in position 20 is any amino acid
  Variant (22)..(22): Xaa in position 22 is any amino acid
  Variant (23)..(23): Xaa in position 23 is any or no amino acid
  Variant (26)..(27): Xaa in position 26 to 27 is any amino acid
  Variant (28)..(28): Xaa in position 28 is Ile or Leu
  Variant (29)..(29): Xaa in position 29 is Leu or Val
  Variant (30)..(30): Xaa in position 30 is Phe or Tyr
  Variant (31)..(31): Xaa in position 31 is His or Lys
  Variant (34)..(34): Xaa in position 34 is Ala or Asp
  Variant (35)..(35): Xaa in position 35 is any amino acid
  Variant (36)..(36): Xaa in position 36 is Pro or Val
  Variant (37)..(38): Xaa in position 37 to 38 is any amino acid
LPIWWKSSLTXXQLXQFXIXMXXQAXXXXXXGCXXXXXR

SEQ ID NO: 171 - DNA, 831 bp, Traustochytrium sp.
  CDS (1)..(831)
atggacgtcgtcgagcagcaatggcgccgcttcgtggacgccgtggacaacggaatcgtggagttcatggagcatgagaagcccaacaagctgaacgagggcaagctcttcacctcgaccgaggagatgatggcgcttatcgtcggctacctggcgttcgtggtcctcgggtccgccttcatgaaggcctttgtcgataagcctttcgagctcaagttcctcaagctcgtgcacaacatcttcctcaccggtctgtccatgtacatggccaccgagtgcgcgcgccaggcatacctcggcggctacaagctctttggcaacccgatggagaagggcaccgagtcgcacgccccgggcatggccaacatcatctacatcttctacgtgagcaagttcctcgaattcctcgacaccgtcttcatgatcctcggcaagaagtggaagcagctcagctttctccacgtctaccaccacgcgagcatcagcttcatctggggcatcatcgcccgcttcgcgcccggtggcgacgcctacttctctaccatcctcaacagcagcgtgcatgtcgtgctctacggctactacgcctcgaccaccctcggctacaccttcatgcgcccgctgcgcccgtacattaccaccattcagctcacgcagttcatggccatggtcgtccagtccgtctatgactactacaacccctgcgactacccgcagcccctcgtcaagctgctcttctggtacatgctcaccatgctcggcctcttcggcaacttcttcgtgcagcagtacctcaagcccaaggcgcccaagaagcagaagaccatctaa

SEQ ID NO: 172 - protein, 276 aa, Traustochytrium sp.
MDVVEQQWRRFVDAVDNGIVEFMEHEKPNKLNEGKLFTSTEEMMALIVGYLAFVVLGSAFMKAFVDKPFELKFLKLVHNIFLTGLSMYMATECARQAYLGGYKLFGNPMEKGTESHAPGMANIIYIFYVSKFLEFLDTVFMILGKKWKQLSFLHVYHHASISFIWGIIARFAPGGDAYFSTILNSSVHVVLYGYYASTTLGYTFMRPLRPYITTIQLTQFMAMVVQSVYDYYNPCDYPQPLVKLLFWYMLTMLGLFGNFFVQQYLKPKAPKKQKTI

SEQ ID NO: 173 - DNA, 1047 bp, Marchantia polymorpha; identical to SEQ ID NO: 124
  CDS (1)..(1047)

SEQ ID NO: 174 - protein, 348 aa, Marchantia polymorpha; identical to SEQ ID NO: 125

SEQ ID NO: 175 - DNA, 831 bp, Thraustochytrium sp; identical to SEQ ID NO: 126
  CDS (1)..(831)

SEQ ID NO: 176 - protein, 276 aa, Thraustochytrium sp; identical to SEQ ID NO: 127

SEQ ID NO: 177 - DNA, 879 bp, Ostreococcus tauri; identical to SEQ ID NO: 130
  CDS (1)..(879)

SEQ ID NO: 178 - protein, 292 aa, Ostreococcus tauri; identical to SEQ ID NO: 123

SEQ ID NO: 179 - DNA, 873 bp, Marchantia polymorpha; identical to SEQ ID NO: 132
  CDS (1)..(873)

SEQ ID NO: 180 - protein, 290 aa, Marchantia polymorpha; identical to SEQ ID NO: 133

SEQ ID NO: 181 - DNA, 873 bp, Physcomitrella patens; identical to SEQ ID NO: 134
  CDS (1)..(873)

SEQ ID NO: 182 - protein, 290 aa, Physcomitrella patens; identical to SEQ ID NO: 135

SEQ ID NO: 183 - DNA, 957 bp, Mortierella alpina; identical to SEQ ID NO: 136
  CDS (1)..(957)

SEQ ID NO: 184 - protein, 318 aa, Mortierella alpina; identical to SEQ ID NO: 137

SEQ ID NO: 185 - protein, 251 aa, Artificial sequence
  Amino acid sequence obtainable by alignment of SEQ ID No. 172, 174, 176, 178, 180, 182, and/or 184
  Variant (2)..(11): Xaa in position 2 to 11 is any amino acid
  Variant (14)..(15): Xaa in position 14 to 15 is any amino acid
  Variant (17)..(23): Xaa in position 17 to 23 is any amino acid
  Variant (25)..(25): Xaa in position 25 is any amino acid
  Variant (26)..(28): Xaa in position 26 to 28 is any or no amino acid
  Variant (30)..(31): Xaa in position 30 to 31 is any amino acid
  Variant (32)..(34): Xaa in position 32 to 34 is any or no amino acid
  Variant (36)..(37): Xaa in position 36 to 37 is any amino acid
  Variant (39)..(44): Xaa in position 39 to 44 is any amino acid
  Variant (47)..(51): Xaa in position 47 to 51 is any amino acid
  Variant (54)..(54): Xaa in position 54 is any amino acid
  Variant (57)..(63): Xaa in position 57 to 63 is any amino acid
  Variant (65)..(68): Xaa in position 65 to 68 is any amino acid
  Variant (70)..(70): Xaa in position 70 is any amino acid
  Variant (72)..(72): Xaa in position 72 is any amino acid
  Variant (75)..(82): Xaa in position 75 to 82 is any amino acid
  Variant (83)..(86): Xaa in position 83 to 86 is any or no amino acid
  Variant (88)..(91): Xaa in position 88 to 91 is any amino acid
  Variant (93)..(93): Xaa in position 93 is any amino acid
  Variant (96)..(96): Xaa in position 96 is any amino acid
  Variant (99)..(100): Xaa in position 99 to 100 is any amino acid
  Variant (103)..(103): Xaa in position 103 is any amino acid
  Variant (106)..(107): Xaa in position 106 to 107 is any amino acid
  Variant (109)..(109): Xaa in position 109 is any amino acid
  Variant (111)..(115): Xaa in position 111 to 115 is any amino acid
  Variant (117)..(119): Xaa in position 117 to 119 is any amino acid
  Variant (126)..(126): Xaa in position 126 is any amino acid
  Variant (129)..(130): Xaa in position 129 to 130 is any amino acid
  Variant (133)..(134): Xaa in position 133 to 134 is any amino acid
  Variant (136)..(138): Xaa in position 136 to 138 is any amino acid
  Variant (143)..(143): Xaa in position 143 is any amino acid
  Variant (148)..(149): Xaa in position 148 to 149 is any amino acid
  Variant (153)..(154): Xaa in position 153 to 154 is any amino acid
  Variant (157)..(158): Xaa in position 157 to 158 is any amino acid
  Variant (160)..(160): Xaa in position 160 is any amino acid
  Variant (163)..(179): Xaa in position 163 to 179 is any amino acid
  Variant (180)..(185): Xaa in position 180 to 185 is any or no amino acid
  Variant (187)..(188): Xaa in position 187 to 188 is any amino acid
  Variant (190)..(191): Xaa in position 190 to 191 is any amino acid
  Variant (194)..(198): Xaa in position 194 to 198 is any amino acid
  Variant (200)..(201): Xaa in position 200 to 201 is any amino acid
  Variant (203)..(208): Xaa in position 203 to 208 is any amino acid
  Variant (209)..(209): Xaa in position 209 is any or no amino acid
  Variant (212)..(217): Xaa in position 212 to 217 is any amino acid
  Variant (219)..(220): Xaa in position 219 to 220 is any amino acid
  Variant (223)..(225): Xaa in position 223 to 225 is any amino acid
  Variant (227)..(227): Xaa in position 227 is any amino acid
  Variant (233)..(246): Xaa in position 233 to 246 is any amino acid
  Variant (247)..(250): Xaa in position 247 to 250 is any or no amino acid
SXXXXXXXXXXYLXXVXXXXXXXKXXXXKXXXXXPXXLXXXXXXHNXXXXXLSXYMXXXXXXXAXXXXYXLXGNXXXXXXXXXXXXMXXXXYXFYXSKXXEFXDTXXMXLXXXXXQXXXLHVYHHXSIXXIWXXIXXXAPGGXAYFSXXLNSXXHVXXYXYYXXXXXXXXXXXXXXXXXXXXXXXTXXQXXQFXXXXXQXXYXXXXXXXYPXXXXXXLXXYMXXXLXLFGNFXXXXXXXXXXXXXXXXXXK

SEQ ID NO: 186 - protein, 60 aa, Artificial sequence
  Amino acid sequence obtainable by alignment of SEQ ID No. 172, 174, 176, 178, 180, 182, and/or 184
  Variant (3)..(4): Xaa in position 3 to 4 is any amino acid
  Variant (7)..(7): Xaa in position 7 is Leu, Met or Val
  Variant (10)..(10): Xaa in position 10 is any amino acid
  Variant (11)..(11): Xaa in position 11 is Phe or Ile
  Variant (13)..(13): Xaa in position 13 is Ile, Leu or Val
  Variant (15)..(18): Xaa in position 15 to 18 is any amino acid
  Variant (19)..(19): Xaa in position 19 is Lys or Arg
  Variant (21)..(21): Xaa in position 21 is Ile, Leu or Val
  Variant (22)..(22): Xaa in position 22 is Ser or Thr
  Variant (23)..(23): Xaa in position 23 is Phe or Val
  Variant (26)..(26): Xaa in position 26 is Ile or Val
  Variant (30)..(30): Xaa in position 30 is Ala or Ser
  Variant (31)..(31): Xaa in position 31 is Ser or Thr
  Variant (33)..(34): Xaa in position 33 to 34 is any amino acid
  Variant (37)..(37): Xaa in position 37 is any amino acid
  Variant (38)..(38): Xaa in position 38 is Ala, Ile or Leu
  Variant (39)..(39): Xaa in position 39 is Ile or Val
  Variant (40)..(40): Xaa in position 40 is Ala or Thr
  Variant (41)..(42): Xaa in position 41 to 42 is any amino acid
  Variant (45)..(45): Xaa in position 45 is Gly or Asn
  Variant (47)..(47): Xaa in position 47 is Asp or Glu
  Variant (50)..(50): Xaa in position 50 is Phe or Trp
  Variant (52)..(52): Xaa in position 52 is Ala or Thr
  Variant (53)..(53): Xaa in position 53 is Ala or Ile
  Variant (57)..(57): Xaa in position 57 is any amino acid
  Variant (58)..(58): Xaa in position 58 is Ile or Val
SKXXEFXDTXXMXLXXXXXQXXXLHXYHHXXIXXIWXXXXXXAPXGXAYXSXXLNSXXHV

SEQ ID NO: 187 - protein, 23 aa, Artificial sequence
  Amino acid sequence obtainable by alignment of SEQ ID No. 172, 174, 176, 178, 180, 182, and/or 184
  Variant (3)..(3): Xaa in position 3 is Leu or Met
  Variant (4)..(4): Xaa in position 4 is Phe or Tyr
  Variant (6)..(6): Xaa in position 6 is Ala or Cys
  Variant (7)..(7): Xaa in position 7 is any amino acid
  Variant (8)..(8): Xaa in position 8 is Glu or Gly
  Variant (9)..(9): Xaa in position 9 is any amino acid
  Variant (10)..(10): Xaa in position 10 is Ala, Ile or Val
  Variant (11)..(11): Xaa in position 11 is any amino acid
  Variant (12)..(12): Xaa in position 12 is Ala or Gln
  Variant (14)..(17): Xaa in position 14 to 17 is any amino acid
  Variant (19)..(19): Xaa in position 19 is any amino acid
  Variant (20)..(20): Xaa in position 20 is Leu or Val
  Variant (21)..(21): Xaa in position 21 is Phe or Trp
LSXXMXXXXXXXAXXXXYXXXGN

SEQ ID NO: 188 - protein, 24 aa, Artificial sequence
  Amino acid sequence obtainable by alignment of SEQ ID No. 172, 174, 176, 178, 180, 182, and/or 184
  Variant (3)..(4): Xaa in position 3 to 4 is any amino acid
  Variant (5)..(5): Xaa in position 5 is Ile or Leu
  Variant (6)..(7): Xaa in position 6 to 7 is any amino acid
  Variant (8)..(8): Xaa in position 8 is Ile or Leu
  Variant (10)..(11): Xaa in position 10 to 11 is any amino acid
  Variant (14)..(14): Xaa in position 14 is any amino acid
  Variant (15)..(15): Xaa in position 15 is Ser or Thr
  Variant (16)..(16): Xaa in position 16 is Leu or Met
  Variant (18)..(18): Xaa in position 18 is any amino acid
  Variant (21)..(22): Xaa in position 21 to 22 is any amino acid
  Variant (24)..(24): Xaa in position 24 is Phe or Tyr
YPXXXXXXLXXYMXXXLXLFXXFX

SEQ ID NO: 189 - protein, 20 aa, Artificial sequence
  Amino acid sequence obtainable by alignment of SEQ ID No. 172, 174, 176, 178, 180, 182, and/or 184
  Variant (2)..(2): Xaa in position 2 is Ile or Leu
  Variant (4)..(5): Xaa in position 4 to 5 is any amino acid
  Variant (7)..(7): Xaa in position 7 is Leu or Met
  Variant (8)..(8): Xaa in position 8 is any amino acid
  Variant (11)..(14): Xaa in position 11 to 14 is any amino acid
  Variant (15)..(15): Xaa in position 15 is Gly, Ile or Val
  Variant (17)..(17): Xaa in position 17 is Ala or Ser
  Variant (18)..(18): Xaa in position 18 is any amino acid
  Variant (19)..(19): Xaa in position 19 is Trp or Tyr
  Variant (20)..(20): Xaa in position 20 is Ala or Asp
YXTXXQXXQFXXXXXQXXXX

SEQ ID NO: 190 - protein, 18 aa, Artificial sequence
  Amino acid sequence obtainable by alignment of SEQ ID No. 172, 174, 176, 178, 180, 182, and/or 184
  Variant (2)..(5): Xaa in position 2 to 5 is any amino acid
  Variant (6)..(6): Xaa in position 6 is any or no amino acid
  Variant (8)..(9): Xaa in position 8 to 9 is any amino acid
  Variant (11)..(12): Xaa in position 11 to 12 is any amino acid
  Variant (13)..(13): Xaa in position 13 is Phe or Leu
  Variant (14)..(14): Xaa in position 14 is any amino acid
  Variant (15)..(15): Xaa in position 15 is Ile or Leu
  Variant (16)..(16): Xaa in position 16 is any amino acid
KXXXXXPXXLXXXXXXHN

SEQ ID NO: 191 - protein, 18 aa, Artificial sequence
  Amino acid sequence obtainable by alignment of SEQ ID No. 172, 174, 176, 178, 180, 182, and/or 184
  Variant (2)..(2): Xaa in position 2 is Pro or Thr
  Variant (3)..(3): Xaa in position 3 is any amino acid
  Variant (4)..(4): Xaa in position 4 is Glu or Pro
  Variant (5)..(5): Xaa in position 5 is Ile, Leu, Met or Val
  Variant (6)..(6): Xaa in position 6 is Leu, Met or Val
  Variant (7)..(8): Xaa in position 7 to 8 is any amino acid
  Variant (9)..(9): Xaa in position 9 is Ile, Leu or Val
  Variant (10)..(11): Xaa in position 10 to 11 is any amino acid
  Variant (14)..(15): Xaa in position 14 to 15 is any amino acid
  Variant (17)..(17): Xaa in position 17 is any amino acid
  Variant (18)..(18): Xaa in position 18 is Gly or Leu
SXXXXXXXXXXYLXXVXX

SEQ ID NO: 192 - protein, 10 aa, Artificial sequence
  Amino acid sequence obtainable by alignment of SEQ ID No. 172, 174, 176, 178, 180, 182, and/or 184
  Variant (2)..(2): Xaa in position 2 is Ala, Gly or Asn
  Variant (3)..(3): Xaa in position 3 is any amino acid
  Variant (4)..(4): Xaa in position 4 is Ile, Leu or Met
  Variant (5)..(5): Xaa in position 5 is Ile, Leu or Val
  Variant (6)..(6): Xaa in position 6 is Trp or Tyr
  Variant (7)..(7): Xaa in position 7 is Ile, Leu or Val
  Variant (10)..(10): Xaa in position 10 is Phe, Met or Val
MXXXXXXFYX

SEQ ID NO: 193 - DNA, 1086 bp, Phytophthora infestans
  CDS (1)..(1086)
atggcgacgaaggaggcgtatgtgttccccactctgacggagatcaagcggtcgctacctaaagactgtttcgaggcttcggtgcctctgtcgctctactacaccgtgcgttgtctggtgatcgcggtggctctaaccttcggtctcaactacgctcgcgctctgcccgaggtcgagagcttctgggctctggacgccgcactctgcacgggctacatcttgctgcagggcatcgtgttctggggcttcttcacggtgggccacgatgccggccacggcgccttctcgcgctaccacctgcttaacttcgtggtgggcactttcatgcactcgctcatcctcacgcccttcgagtcgtggaagctcacgcaccgtcaccaccacaagaacacgggcaacattgaccgtgacgaggtcttctacccgcaacgcaaggccgacgaccacccgctgtctcgcaacctgattctggcgctcggggcagcgtggctcgcctatttggtcgagggcttccctcctcgtaaggtcaaccacttcaacccgttcgagcctctgttcgtgcgtcaggtgtcagctgtggtaatctctcttctcgcccacttcttcgtggccggactctccatctatctgagcctccagctgggccttaagacgatggcaatctactactatggacctgtttttgtgttcggcagcatgctggtcattaccaccttcctacaccacaatgatgaggagaccccatggtacgccgactcggagtggacgtacgtcaagggcaacctctcgtccgtggaccgatcgtacggcgcgctcattgacaacctgagccacaacatcggcacgcaccagatccaccaccttttccctatcattccgcactacaaactcaagaaagccactgcggccttccaccaggctttccctgagctcgtgcgcaagagcgacgagccaattatcaaggctttcttccgggttggacgtctctacgcaaactacggcgttgtggaccaggaggcgaagctcttcacgctaaaggaagccaaggcggcgaccgaggcggcggccaagaccaagtccacgtaa

SEQ ID NO: 194 - protein, 361 aa, Phytophthora infestans
MATKEAYVFPTLTEIKRSLPKDCFEASVPLSLYYTVRCLVIAVALTFGLNYARALPEVESFWALDAALCTGYILLQGIVFWGFFTVGHDAGHGAFSRYHLLNFVVGTFMHSLILTPFESWKLTHRHHHKNTGNIDRDEVFYPQRKADDHPLSRNLILALGAAWLAYLVEGFPPRKVNHFNPFEPLFVRQVSAVVISLLAHFFVAGLSIYLSLQLGLKTMAIYYYGPVFVFGSMLVITTFLHHNDEETPWYADSEWTYVKGNLSSVDRSYGALIDNLSHNIGTHQIHHLFPIIPHYKLKKATAAFHQAFPELVRKSDEPIIKAFFRVGRLYANYGVVDQEAKLFTLKEAKAATEAAAKTKST

SEQ ID NO: 195 - DNA, 1077 bp, Saprolegnia diclina
  CDS (1)..(1077)
atgactgaggataagacgaaggtcgagttcccgacgctcacggagctcaagcactcgatcccgaacgcgtgctttgagtcgaacctcggcctctcgctctactacacggcccgcgcgatcttcaacgcgtcggcctcggcggcgctgctctacgcggcgcgctcgacgccgttcattgccgataacgttctgctccacgcgctcgtttgcgccacctacatctacgtgcagggcgtcatcttctggggcttcttcacggtcggccacgactgcggccactcggccttctcgcgctaccacagcgtcaactttatcatcggctgcatcatgcactctgcgattttgacgccgttcgagagctggcgcgtgacgcaccgccaccaccacaagaacacgggcaacattgataaggacgagatcttttacccgcaccggtcggtcaaggacctccaggacgtgcgccaatgggtctacacgctcggcggtgcgtggtttgtctacttgaaggtcgggtatgccccgcgcacgatgagccactttgacccgtgggacccgctcctccttcgccgcgcgtcggccgtcatcgtgtcgctcggcgtctgggccgccttcttcgccgcgtacgcgtacctcacatactcgctcggctttgccgtcatgggcctctactactatgcgccgctctttgtctttgcttcgttcctcgtcattacgaccttcttgcaccacaacgacgaagcgacgccgtggtacggcgactcggagtggacgtacgtcaagggcaacctctcgagcgtcgaccgctcgtacggcgcgttcgtggacaacctgagccaccacattggcacgcaccaggtccaccacttgttcccgatcattccgcactacaagctcaacgaagccaccaagcactttgcggccgcgtacccgcacctcgtgcgcaggaacgacgagcccatcatcacggccttcttcaagaccgcgcacctctttgtcaactacggcgctgtgcccgagacggcgcagatcttcacgctcaaagagtcggccgcggccgccaaggccaagtcggactaa

SEQ ID NO: 196 - protein, 358 aa, Saprolegnia diclina
MTEDKTKVEFPTLTELKHSIPNACFESNLGLSLYYTARAIFNASASAALLYAARSTPFIADNVLLHALVCATYIYVQGVIFWGFFTVGHDCGHSAFSRYHSVNFIIGCIMHSAILTPFESWRVTHRHHHKNTGNIDKDEIFYPHRSVKDLQDVRQWVYTLGGAWFVYLKVGYAPRTMSHFDPWDPLLLRRASAVIVSLGVWAAFFAAYAYLTYSLGFAVMGLYYYAPLFVFASFLVITTFLHHNDEATPWYGDSEWTYVKGNLSSVDRSYGAFVDNLSHHIGTHQVHHLFPIIPHYKLNEATKHFAAAYPHLVRRNDEPIITAFFKTAHLFVNYGAVPETAQIFTLKESAAAAKAKSD

SEQ ID NO: 197 - protein, 359 aa, Artificial sequence
  Amino acid sequence obtainable by alignment of SEQ ID No. 194 and/or 196
  Variant (2)..(5): Xaa in position 2 to 5 is any amino acid
  Variant (12)..(12): Xaa in position 12 is any amino acid
  Variant (14)..(14): Xaa in position 14 is any amino acid
  Variant (16)..(16): Xaa in position 16 is any amino acid
  Variant (18)..(19): Xaa in position 18 to 19 is any amino acid
  Variant (23)..(26): Xaa in position 23 to 26 is any amino acid
  Variant (33)..(33): Xaa in position 33 is any amino acid
  Variant (35)..(38): Xaa in position 35 to 38 is any amino acid
  Variant (40)..(40): Xaa in position 40 is any amino acid
  Variant (42)..(45): Xaa in position 42 to 45 is any amino acid
  Variant (47)..(48): Xaa in position 47 to 48 is any amino acid
  Variant (51)..(52): Xaa in position 51 to 52 is any amino acid
  Variant (54)..(60): Xaa in position 54 to 60 is any amino acid
  Variant (62)..(62): Xaa in position 62 is any amino acid
  Variant (64)..(65): Xaa in position 64 to 65 is any amino acid
  Variant (67)..(68): Xaa in position 67 to 68 is any amino acid
  Variant (71)..(72): Xaa in position 71 to 72 is any amino acid
  Variant (75)..(76): Xaa in position 75 to 76 is any amino acid
  Variant (87)..(87): Xaa in position 87 is any amino acid
  Variant (90)..(90): Xaa in position 90 is any amino acid
  Variant (97)..(98): Xaa in position 97 to 98 is any amino acid
  Variant (101)..(102): Xaa in position 101 to 102 is any amino acid
  Variant (104)..(105): Xaa in position 104 to 105 is any amino acid
  Variant (109)..(109): Xaa in position 109 is any amino acid
  Variant (118)..(119): Xaa in position 118 to 119 is any amino acid
  Variant (133)..(133): Xaa in position 133 is any amino acid
  Variant (136)..(136): Xaa in position 136 is any amino acid
  Variant (140)..(140): Xaa in position 140 is any amino acid
  Variant (142)..(144): Xaa in position 142 to 144 is any amino acid
  Variant (146)..(149): Xaa in position 146 to 149 is any amino acid
  Variant (151)..(155): Xaa in position 151 to 155 is any amino acid
  Variant (158)..(158): Xaa in position 158 is any amino acid
  Variant (161)..(162): Xaa in position 161 to 162 is any amino acid
  Variant (165)..(166): Xaa in position 165 to 166 is any amino acid
  Variant (168)..(169): Xaa in position 168 to 169 is any amino acid
  Variant (172)..(174): Xaa in position 172 to 174 is any amino acid
  Variant (177)..(177): Xaa in position 177 is any amino acid
  Variant (179)..(180): Xaa in position 179 to 180 is any amino acid
  Variant (183)..(184): Xaa in position 183 to 184 is any amino acid
  Variant (186)..(187): Xaa in position 186 to 187 is any amino acid
  Variant (191)..(192): Xaa in position 191 to 192 is any amino acid
  Variant (195)..(195): Xaa in position 195 is any amino acid
  Variant (196)..(197): Xaa in position 196 to 197 is any or no amino acid
  Variant (199)..(199): Xaa in position 199 is any amino acid
  Variant (202)..(202): Xaa in position 202 is any amino acid
  Variant (204)..(205): Xaa in position 204 to 205 is any amino acid
  Variant (206)..(207): Xaa in position 206 to 207 is any or no amino acid
  Variant (210)..(212): Xaa in position 210 to 212 is any amino acid
  Variant (215)..(217): Xaa in position 215 to 217 is any amino acid
  Variant (219)..(220): Xaa in position 219 to 220 is any amino acid
  Variant (224)..(224): Xaa in position 224 is any amino acid
  Variant (226)..(226): Xaa in position 226 is any amino acid
  Variant (230)..(230): Xaa in position 230 is any amino acid
  Variant (232)..(232): Xaa in position 232 is any amino acid
  Variant (245)..(245): Xaa in position 245 is any amino acid
  Variant (250)..(250): Xaa in position 250 is any amino acid
  Variant (271)..(272): Xaa in position 271 to 272 is any amino acid
  Variant (278)..(278): Xaa in position 278 is any amino acid
  Variant (284)..(284): Xaa in position 284 is any amino acid
  Variant (297)..(298): Xaa in position 297 to 298 is any amino acid
  Variant (301)..(302): Xaa in position 301 to 302 is any amino acid
  Variant (304)..(305): Xaa in position 304 to 305 is any amino acid
  Variant (307)..(307): Xaa in position 307 is any amino acid
  Variant (309)..(309): Xaa in position 309 is any amino acid
  Variant (313)..(314): Xaa in position 313 to 314 is any amino acid
  Variant (320)..(320): Xaa in position 320 is any amino acid
  Variant (324)..(327): Xaa in position 324 to 327 is any amino acid
  Variant (329)..(330): Xaa in position 329 to 330 is any amino acid
  Variant (334)..(334): Xaa in position 334 is any amino acid
  Variant (336)..(338): Xaa in position 336 to 338 is any amino acid
  Variant (340)..(341): Xaa in position 340 to 341 is any amino acid
  Variant (347)..(348): Xaa in position 347 to 348 is any amino acid
  Variant (349)..(352): Xaa in position 349 to 352 is any or no amino acid
  Variant (357)..(357): Xaa in position 357 is any amino acid
KXXXXFPTLTEXKXSXPXXCFEXXXXLSLYYTXRXXXXAXAXXXXLXXARXXPXXXXXXXLXAXXCXXYIXXQGXXFWGFFTVGHDXGHXAFSRYHXXNFXXGXXMHSXILTPFESWXXTHRHHHKNTGNIDXDEXFYPXRXXXDXXXXRXXXXXLGXAWXXYLXXGXXPRXXXHFXPXXPLXXRXXSAVXXSLXXXAXFFXAXXXXYLXXXLGXXXMXXYYYXPXFVFXSXLVITTFLHHNDEXTPWYXDSEWTYVKGNLSSVDRSYGAXXDNLSHXIGTHQXHHLFPIIPHYKLXXATXXFXXAXPXLVRXXDEPIIXAFFXXXXLXXNYGXVXXXAXXFTLKEXXXXXXAAAKXKS

SEQ ID NO: 198 - protein, 60 aa, Artificial sequence
  Amino acid sequence obtainable by alignment of SEQ ID No. 194 and/or 196
  Variant (10)..(10): Xaa in position 10 is Ala or Glu
  Variant (15)..(15): Xaa in position 15 is Ala or Gly
  Variant (36)..(36): Xaa in position 36 is Phe or Leu
  Variant (37)..(37): Xaa in position 37 is Ile or Val
  Variant (43)..(43): Xaa in position 43 is any amino acid
  Variant (49)..(49): Xaa in position 49 is Ile or Val
TTFLHHNDEXTPWYXDSEWTYVKGNLSSVDRSYGAXXDNLSHXIGTHQXHHLFPIIPHYK

SEQ ID NO: 199 - protein, 60 aa, Artificial sequence
  Amino acid sequence obtainable by alignment of SEQ ID No. 194 and/or 196
  Variant (6)..(6): Xaa in position 6 is Ala or Cys
  Variant (9)..(9): Xaa in position 9 is Gly or Ser
  Variant (16)..(16): Xaa in position 16 is any amino acid
  Variant (17)..(17): Xaa in position 17 is Leu or Val
  Variant (20)..(21): Xaa in position 20 to 21 is Ile or Val
  Variant (23)..(23): Xaa in position 23 is Cys or Thr
  Variant (24)..(24): Xaa in position 24 is Phe or Ile
  Variant (28)..(28): Xaa in position 28 is Ala or Leu
  Variant (37)..(37): Xaa in position 37 is Lys or Arg
  Variant (38)..(38): Xaa in position 38 is Leu or Val
  Variant (52)..(52): Xaa in position 52 is Lys or Arg
  Variant (55)..(55): Xaa in position 55 is Ile or Val
  Variant (59)..(59): Xaa in position 59 is any amino acid
TVGHDXGHXAFSRYHXXNFXXGXXMHSXILTPFESWXXTHRHHHKNTGNIDXDEXFYPXR

SEQ ID NO: 200 - DNA, 61 bp, Artificial sequence
  Primer
gaattcggcgcgccgagctcctcgagcaacggttccggcggtatagagttgggtaattcga

SEQ ID NO: 201 - DNA, 45 bp, Artificial sequence
  Primer
cccgggatcgatgccggcagatctccaccattttttggtggtgat

SEQ ID NO: 202 - DNA, 40 bp, Artificial sequence
  Primer
aggcctccatggcctgctttaatgagatatgcgagacgcc

SEQ ID NO: 203 - DNA, 32 bp, Artificial sequence
  Primer
cccgggccggacaatcagtaaattgaacggag

SEQ ID NO: 204 - DNA, 26 bp, Artificial sequence
  Primer
aggcctcaacggttccggcggtatag

SEQ ID NO: 205 - DNA, 60 bp, Artificial sequence
  Primer
cccggggttaacgctagcgggcccgatatcggatcccattttttggtggtgattggttct

SEQ ID NO: 206 - DNA, 31 bp, Artificial sequence
  Primer
aggcctcctgctttaatgagatatgcgagac

SEQ ID NO: 207 - DNA, 31 bp, Artificial sequence
  Primer
cccgggcggacaatcagtaaattgaacggag

SEQ ID NO: 208 - DNA, 28 bp, Artificial sequence
  Primer
aggcctcaacggttccggcggtatagag

SEQ ID NO: 209 - DNA, 50 bp, Artificial sequence
  Primer
aggccttctagactgcaggcggccgcccgcattttttggtggtgattggt

SEQ ID NO: 210 - DNA, 27 bp, Artificial sequence
  Primer
ggcctcctgctttaatgagatatgcga

SEQ ID NO: 211 - DNA, 51 bp, Artificial sequence
  Primer
aagcttggcgcgccgagctcgtcgacggacaatcagtaaattgaacggaga

SEQ ID NO: 212 - DNA, 30 bp, Artificial sequence
  Primer
agatctatggtggacctcaagcctggagtg

SEQ ID NO: 213 - DNA, 36 bp, Artificial sequence
  Primer
ccatggcccgggttacatcgctgggaactcggtgat

SEQ ID NO: 214 - DNA, 30 bp, Artificial sequence
  Primer
gggatccatgggcaagggcagcgagggccg

SEQ ID NO: 215 - DNA, 33 bp, Artificial sequence
  Primer
ggcgccgacaccaagaagcaggactgagatatc

SEQ ID NO: 216 - DNA, 36 bp, Artificial sequence
  Primer
gcggccgcatggaggtcgtggagagattctacggtg

SEQ ID NO: 217 - DNA, 31 bp, Artificial sequence
  Primer
gcaaaagggagctaaaactgagtgatctaga

SEQ ID NO: 218 - DNA, 31 bp, Artificial sequence
  Primer
gtcgatcaacggttccggcggtatagagttg

SEQ ID NO: 219 - DNA, 32 bp, Artificial sequence
  Primer
gtcgatcggacaatcagtaaattgaacggaga

SEQ ID NO: 220 - DNA, 28 bp, Artificial sequence
  Primer
agatctatgggtgcaggcggtcgaatgc

SEQ ID NO: 221 - DNA, 26 bp, Artificial sequence
  Primer
ccatggttaaatcttattacgatacc

We claim:

1. A process for producing a transgenic plant producing eicosapentaenoic acid, docosapentaenoic acid and/or docosahexaenoic acid comprising introducing into a plant:
   a) a nucleic acid sequence encoding a polypeptide having Δ6-desaturase activity, wherein said polypeptide has an amino acid sequence that is at least 95% identical to SEQ ID NO: 2;
   b) a nucleic acid sequence encoding a polypeptide having Δ6-elongase activity, wherein said polypeptide has an amino acid sequence that is at least 95% identical to SEQ ID NO: 172;
   c) a nucleic acid sequence encoding a polypeptide having Δ5-desaturase activity, wherein said polypeptide has an amino acid sequence that is at least 95% identical to SEQ ID NO: 52;
   d) a nucleic acid sequence encoding a polypeptide having Δ5-elongase activity, wherein said nucleic acid sequence is at least 90% identical to SEQ ID NO: 64; and
   e) optionally a nucleic acid sequence encoding a polypeptide having Δ4-desaturase activity, wherein said polypeptide has an amino acid sequence that is at least 95% identical to SEQ ID NO: 78;
   wherein the nucleic acid sequence encoding the polypeptide having Δ5-elongase activity is modified to adapt to the codon usage in one or more plant species.

2. The process of claim 1, wherein the nucleic acid sequence encoding the polypeptide having Δ5-elongase activity is adapted to codon usage in oilseed rape, soybean and/or flax.

3. The process of claim 1, wherein the nucleic acid sequence encoding the polypeptide having Δ5-elongase activity comprises the nucleotide sequence of SEQ ID NO: 64 or a nucleotide sequence that is at least 95% identical to SEQ ID NO: 64.

4. The process of claim 1, wherein the nucleic acid sequences are expressed under the control of a seed-specific promoter.

5. The process of claim 4, wherein the seed-specific promoter is an unknown seed protein (USP) promoter, a vicilin promoter, a napin promoter, a peroxireduxin promoter, a legumin promoter, a conlinin promoter, or an oleosin promoter.

6. The process of claim 5, wherein the plant produces polyunsaturated C22 fatty acids in seed oil that is at least 5% by weight or more of seed oil content.

7. The process of claim 1, further comprising introducing into said plant one or more nucleic acid sequences coding for a polypeptide having ω3 desaturase activity and/or Δ4-desaturase activity.

8. The process of claim 7, wherein the plant produces docosahexaenoic acid in seed oil that is at least 1% by weight or more of seed oil content.

9. The process of claim 1, wherein the eicosapentaenoic acid, docosapentaenoic acid and/or docosahexaenoic acid is present in the plant mainly bound as ester in phospholipids or triacylglycerides.

10. The process of claim 1, wherein the plant is an oil-producing plant selected from the group consisting of *Brassica napus, Brassica juncea* and *Glycine max*.

11. The process of claim 1, further comprising obtaining the eicosapentaenoic acid, docosapentaenoic acid and/or docosahexaenoic acid in the form of their oils, lipids or free fatty acids from the plant.

12. The process of claim 1, wherein the polypeptide having Δ6-desaturase activity comprises the sequence of SEQ ID NO: 2; the polypeptide having Δ6-elongase activity comprises the sequence of SEQ ID NO: 172; the polypeptide having Δ5-desaturase activity comprises the sequence of SEQ ID NO: 52; the polypeptide having Δ5-elongase activity comprises the sequence of SEQ ID NO: 65; and the polypeptide having Δ4-desaturase activity comprises the sequence of SEQ ID NO: 78.

13. A recombinant nucleic acid molecule comprising:
   a) one or more copies of a promoter that is active in plant cells;
   b) a nucleic acid sequence encoding a polypeptide having Δ6-desaturase activity, wherein said polypeptide has an amino acid sequence that is at least 95% identical to SEQ ID NO: 2;
   c) a nucleic acid sequence encoding a polypeptide having Δ5-desaturase activity, wherein said polypeptide has an amino acid sequence that is at least 95% identical to SEQ ID NO: 52;
   d) a nucleic acid sequence encoding a polypeptide having Δ6-elongase activity, wherein said polypeptide has an amino acid sequence that is at least 95% identical to SEQ ID NO: 172;
   e) a nucleic acid sequence encoding a polypeptide having Δ5-elongase activity, wherein said nucleic acid sequence is at least 90% identical to SEQ ID NO: 64, and wherein said nucleic acid sequence is modified to adapt to the codon usage in one or more plant species by taking into account the natural frequency of individual codons; and
   f) one or more copies of a terminator sequence.

14. The recombinant nucleic acid molecule of claim 13, wherein the nucleic acid sequence encoding the polypeptide having Δ5-elongase activity comprises the nucleotide sequence of SEQ ID NO: 64 or a nucleotide sequence that is at least 95% identical to SEQ ID NO: 64.

15. The recombinant nucleic acid molecule of claim 13, further comprising one or more nucleic acid sequences coding for a polypeptide having ω3-desaturase activity and/or Δ4-desaturase activity.

16. The recombinant nucleic acid molecule of claim 13, wherein the polypeptide having Δ6-desaturase activity comprises the sequence of SEQ ID NO: 2; the polypeptide having Δ5-desaturase activity comprises the sequence of SEQ ID NO: 52; the polypeptide having Δ6-elongase activity comprises the sequence of SEQ ID NO: 172; the polypeptide having Δ5-elongase activity comprises the sequence of SEQ ID NO: 65.

17. The process of claim 4, wherein the seed-specific promoter is a ω3-desaturase (Fad3) promoter.

* * * * *